(12) United States Patent
Fitzgerald et al.

(10) Patent No.: US 8,273,869 B2
(45) Date of Patent: Sep. 25, 2012

(54) LIPID FORMULATED DSRNA TARGETING THE PCSK9 GENE

(75) Inventors: Kevin Fitzgerald, Brookline, MA (US); Gregory Hinkle, Plymouth, MA (US); Akin Akinc, Needham, MA (US); Stuart Milstein, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 12/816,207

(22) Filed: Jun. 15, 2010

(65) Prior Publication Data

US 2011/0015252 A1    Jan. 20, 2011

Related U.S. Application Data

(60) Provisional application No. 61/187,169, filed on Jun. 15, 2009, provisional application No. 61/218,350, filed on Jun. 18, 2009, provisional application No. 61/244,790, filed on Sep. 22, 2009, provisional application No. 61/285,598, filed on Dec. 11, 2009, provisional application No. 61/293,474, filed on Jan. 8, 2010, provisional application No. 61/313,578, filed on Mar. 12, 2010.

(51) Int. Cl.
*C07H 21/04* (2006.01)
*C12N 15/85* (2006.01)

(52) U.S. Cl. ........................ 536/24.5; 536/23.1; 435/325

(58) Field of Classification Search ........................ None
See application file for complete search history.

(56) References Cited

U.S. PATENT DOCUMENTS

| | | | |
|---|---|---|---|
| 6,054,299 A | 4/2000 | Conrad | |
| 6,271,359 B1 | 8/2001 | Norris et al. | |
| 7,427,605 B2 | 9/2008 | Davis et al. | |
| 7,605,251 B2 | 10/2009 | Tan et al. | |
| 7,718,629 B2 | 5/2010 | Bumcrot et al. | |
| 2003/0143732 A1 | 7/2003 | Fosnaugh et al. | |
| 2003/0170891 A1 | 9/2003 | McSwiggen | |
| 2003/0229017 A1 | 12/2003 | Massing et al. | |
| 2004/0009216 A1 | 1/2004 | Rodrigueza et al. | |
| 2004/0259247 A1 | 12/2004 | Tuschl et al. | |
| 2005/0170508 A1 | 8/2005 | Huang et al. | |
| 2006/0008910 A1 | 1/2006 | MacLachlan et al. | |
| 2006/0083780 A1 | 4/2006 | Heyes et al. | |
| 2006/0134189 A1 | 6/2006 | Maclachlan et al. | |
| 2006/0240093 A1 | 10/2006 | MacLachlan et al. | |
| 2006/0263435 A1 | 11/2006 | Davis et al. | |
| 2007/0004664 A1 | 1/2007 | McSwiggen et al. | |
| 2007/0031844 A1 | 2/2007 | Khvorova et al. | |
| 2007/0135372 A1 | 6/2007 | MacLachlan et al. | |
| 2007/0173473 A1 | 7/2007 | McSwiggen et al. | |
| 2007/0281899 A1 | 12/2007 | Bumcrot et al. | |
| 2008/0113930 A1 | 5/2008 | Tan et al. | |
| 2008/0188675 A1 | 8/2008 | Chen et al. | |
| 2008/0249040 A1 | 10/2008 | McSwiggen et al. | |
| 2008/0253960 A1* | 10/2008 | Zheng et al. .................. 424/1.11 | |
| 2009/0023215 A1 | 1/2009 | Jessee et al. | |
| 2009/0023673 A1 | 1/2009 | Manoharan et al. | |
| 2009/0142352 A1 | 6/2009 | Jackson et al. | |
| 2009/0149403 A1 | 6/2009 | MacLachlan | |
| 2009/0291131 A1 | 11/2009 | MacLachlan et al. | |
| 2010/0010066 A1 | 1/2010 | Fitzgerald et al. | |
| 2010/0120893 A1* | 5/2010 | Sah et al. .................. 514/44 A |
| 2010/0130588 A1 | 5/2010 | Yaworksi et al. | |
| 2010/0168206 A1 | 7/2010 | Gollob et al. | |
| 2010/0324120 A1 | 12/2010 | Chen et al. | |
| 2011/0015250 A1 | 1/2011 | Bumcrot et al. | |
| 2011/0117125 A1 | 5/2011 | Hope et al. | |
| 2011/0256175 A1 | 10/2011 | Hope et al. | |

FOREIGN PATENT DOCUMENTS

| | | |
|---|---|---|
| DE | 10100586 | 11/2002 |
| WO | WO 96/40964 | 12/1996 |
| WO | WO 99/32619 | 7/1999 |
| WO | WO 99/53050 | 10/1999 |
| WO | WO 99/61631 | 12/1999 |
| WO | WO 00/22113 | 4/2000 |
| WO | WO 00/22114 | 4/2000 |
| WO | WO 00/44895 | 8/2000 |
| WO | WO 03/070918 A | 8/2003 |
| WO | WO 2004/065601 | 8/2004 |
| WO | WO 2004/080406 | 9/2004 |
| WO | WO 2004/090108 | 10/2004 |
| WO | WO 2005/014782 A | 2/2005 |
| WO | WO 2005/120152 | 12/2005 |
| WO | WO 2007/012191 | 2/2007 |
| WO | WO 2007/115168 | 10/2007 |
| WO | WO 2007/134161 | 11/2007 |
| WO | WO 2007/134161 A2 | 11/2007 |
| WO | WO 2008/042973 | 4/2008 |
| WO | WO 2008/109472 * | 9/2008 ...................... 514/44 |
| WO | WO 2009/111658 | 9/2009 |
| WO | WO 2009/127060 | 10/2009 |
| WO | WO 2009/134487 | 11/2009 |
| WO | WO 2010/054406 | 5/2010 |
| WO | WO 2010/088537 | 8/2010 |
| WO | WO 2010/129709 | 11/2010 |

(Continued)

OTHER PUBLICATIONS

Examination Report for New Zealand Patent Application No. 572666, Sep. 21, 2010, 2 pages.
PCT International Search Report and Written Opinion, PCT/US2010/047726, Dec. 13, 2010, 32 Pages.
PCT Invitation to Pay Additional Fees and, Where Applicable, Protest Fee, PCT/US2010/038707, Oct. 14, 2010, 2 Pages.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila* Melanogaster Embryo Lysate", The EMBO Journal, 2001, pp. 6877-6888, vol. 20, No. 23.
Elbashir, S., et al., "RNA Interference is Mediated by 21-and 22 Nucleotide RNAs," Genes & Development, 2001, pp. 188-200, vol. 15.

(Continued)

*Primary Examiner* — Amy Bowman
(74) *Attorney, Agent, or Firm* — Fenwick & West LLP

(57) ABSTRACT

This invention relates to composition and methods using lipid formulated siRNA targeted to a PCSK9 gene.

27 Claims, 34 Drawing Sheets

FOREIGN PATENT DOCUMENTS

| WO | WO 2010/144740 | 12/2010 |
|---|---|---|
| WO | WO 2010/148013 | 12/2010 |

OTHER PUBLICATIONS

Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in *Caenorhabditis elegans*," Nature, Feb. 19, 1998, pp. 806-811, vol. 391.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation by Double-Stranded RNA In Vitro," Genes & Development, 1999, pp. 3191-3197, vol. 13.
Tuschl, T., "Expanding small RNA interference," Nature Biotechnology, May 2002, pp. 446-448, vol. 20.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.
First Office Action mailed on Jun. 27, 2011, for Chinese Patent Application No. 200780024854.1, 14 pages.
Reynolds, et al. (2004) "Rational siRNA design for RNA interference," Nature Biotechnology, vol. 22, No. 3, pp. 326-330.
Robbins, M., et al., "Stable expression of shRNAs in human CD34+ progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Weil, et al (2002) "Targeting the Kinesin Eg5 to Monitor siRNA Transfection in Mammalian Cells," *Biotechniques* 33(6):1244-1248.
Office Action for Canada Patent Application No. CA 2,651,839, Sep. 6, 2011, 3 pages.
Fitzgerald, K., et al., "Abstract 583: RNAi Therapeutics for the Lowering of Cholesterol," Circulation, 2007, p. II_105, vol. 116, American Heart Association, Inc.
Abifadel et al., "Mutations in PCSK9 Cause Autosomal Dominant Hypercholesterolemia", Nature Genetics, 2003, 34, pp. 154-156.
Akdim et al., "Antisense apolipoprotein B therapy: where do we stand?" *Curr. Opin. Lipidol.* 18:397-400, 2007.
Basak, "Inhibitors of Proprotein Convertases". Journal of Molecular Medicine, 2002, 83, pp. 844-855.
Benjannet et al., "NARC-1/PCSK9 and it's Natural Mutants", Journal of Biological Chemistry, 2004, 279, pp. 48865-48875.
Bergeron et al., "Subtilase-Like Pro-Protein Convertases: from Molecular Specificity to Therapeutic Applications", Journal of Molecular Endocrinology, 2000, 24, pp. 1-22.
Betteridge, et al., "Treatment of familial hypercholesterolaema. United Kingdom lipid clinics study of pravastatin and cholestyramine," BMJ, May 23, 1992, pp. 1335-1338, vol. 304.
Couture et al., "Anti-gene Therapy: The Use of Ribozymes to Inhibit Gene Function", TIG, 1996, 12, pp. 510-515.
Cohen et al., "Molecular Mechanisms of Autosomal Recessive Hypercholesterolemia", Current Opinion in Lipidology, 2003, 14, pp. 121-127.
Cohen et al, "Low LDL Cholesterol in Individuals of African Descent Resulting from Frequent Mutations in PCSK9", Nature Genetics, 2005, 37, pp. 161-165.
Cohen et al., "Sequence Variations in PCSK9, Low LDL, and Protection Against Coronary Heart Disease", New England Journal of Medicine, 2006, 354, pp. 1264-1272.
Dubuc et al., Arteriosclerosis, Thrombosis, and Vascular Biology, Journal of the American Heart Association, 2004, 24, pp. 1454-1459.
Gassman et al., "Maintenance of an Extrachromosomal Plasmid Vector in Mouse Embryonic Stem Cells", Proc. Natl. Acad, Sci., 1995, 92, pp. 1292-1296.
Gensberg, K., "Subtilisin-related serine proteases in the mammalian constitutive secretory pathway," (1998) *Semin. Cell Dev. Biol.* 9, 11-17.
Graham et al., "Antisense Inhibition of Proprotein Convertase Subtilism/Kexin Type 9 Reduces Serum LDL in Hyperlipidemix Mice", Journal of Lipid Research, 2007, 48, pp. 767-769.
Heyes, J., et al., "Cationic lipid saturation influences intracellular delivery of encapsulated nucleic acids," Journal of Controlled Release, 2005, pp. 276-287, vol. 107.
Harborth, J., et al., "Sequence, chemical and structural variation of small interfering RNAs and short hairpin RNAs and the effect on mammalian gene," Antisense & Nucleic Acid Drug Development, Apr. 1, 2003, pp. 83-105, vol. 1, No. 2.
Legace et al., "Secreted PCSK9 decreases the number of LDL receptors in hepatocytes and inlivers of parabiotic mice," *J Clin Invest.* 116:2995-3005, 2006.
Leren, "Mutations in the PCSK9 Gene in Norwegian Subjects with Autosomal Dominant Hypercholesterolemia", Clinical Genetics, 2004, pp. 419-422.
Li et al., "Folate-Mediated Targeting of Antisense Oligodeoxynucleotides to Ovarian Cancer Cells", Phar. Research, 1998, 15, pp. 1540-1545.
Love, K., et al., "Lipid-like materials for low-dose, in vivo gene silencing," PNAS, Feb. 2, 2010, pp. 1864-69, vol. 107, No. 5.
Lu et al., "Delivering siRNA in Vivo for Functional Genomics and Novel Therapeutics in RNA Interference Technology", Cambridge, Appasani, 2005, pp. 303-317.
Maxwell et al., "Novel Putative SREBP and LXR Target Genes Identified by Microarray Analysis in Liver of Cholesterol-Fed Mice", Journal of Lipid Research, 2003, 44, pp. 2109-2119.
Maxwell et al., "Adenoviral-Mediated Expression of Pcsk9 in Mice Results in a Low-Density LipoProtein Receptor Knockout Phenotype", Proc. Acad. Sci. USA, 2004, 101, 7100-7105.
Manoharan, "Oligonucleotide Conjugates as Potential Antisense Drugs with Improved Uptake, Biodistribution, Targeted Delivery, and Mechanism of Action", Antisense & Nucleic Acid Drug Development, 2002, 12 pp. 103-128.
Morrissey et al., "Potent and Persistent in Vivo Anti-HBV Activity of Chemically Modified siRNAs", Nature Biotechnology, 2005, 23, pp. 1002-1007.
Park et al., "Post-Transcriptional Regulation of Low Density Lipoprotein Receptor Protein by Proprotein Convertase Subtilisin/Kexin Type 9a in Mouse Liver", Journal of Biological Chemistry, 2004, 279, pp. 50630-50638.
Rader et al., "Monogenic Hypercholesterolemia: New Insights in Pathogenesis and Treatment", Journal of Clinical Investigation, 2003, 111, pp. 1795-1803.
Rashid et al., "Decreased Plasma Cholesterol and Hypersensitivity to Statins in Mice Lacking Pcsk9", PNAS, 2005, 102, pp. 5374-5379.
Samarsky et al., "RNAi in Drug development: Practical Considerations in RNA Interference Technology", Cambridge, Appasani, 2005, pp. 384-395.
Sauer, I., et al., "An Apolipoprotein E-Derived Peptide Mediates Uptake of Sterically Stabilized Liposomes into Brain Capillary Endothelial Cells," Biochemistry, 2005, pp. 2021-2029, vol. 44, No. 6.
Seidah et al., "Proprotein and Prohormone Convertases: A Family of Subtilases Generating Diverse Bioactive Polypeptides", Brain Research, 1999, pp. 45-62.
Shioji et al., "Genetic Variants in PCSK9 Affect the Cholesterol Level in Japanese", J. Hum Genet, 2004, pp. 109-114.
Templeton et al., "Improved DNA: Liposome Complexes for Increased Systemic Delivery and Gene Expression", Nature Biotechnology, 1997, 15, pp. 647-652.
Timms et al., "A Mutation in PCSK9 Causing Autosomal-Dominant Hypercholesterolemia in a Utah Pedigree", Humm Genet, 2004, 114, pp. 349-353.
Yang et al., "Evidence that Processed Small dsRNAs May Mediate Sequence-Specific mRNA Degradation During RNAi in *Drosophila* Embryos", Current Biology, 2000, pp. 1191-1200.

Zhou et al., Proteolytic Processing in the Secretory Pathway, Journal of Biological Chemistry, 1999, 274, pp. 20745-20748.

Zimmerman, et al., "RNAi-mediated gene silencing in non-human primates," Nature, May 4, 2006, pp. 111-114, With supplementary information, vol. 441.

NM 174936, NCBI, 2006, pp. 1-5.

NM 153565, NCBI, 2006, pp. 1-4.

NM 199253, NCBI, 2006, pp. 1-4.

Genbank Accession No. NM.sub.—174936. *Homo sapiens* proprotein convertase subtilisin/kexin type 9 (PCSK9), mRNA. 2007, p. 1-6.

PCT International Search Report and Written Opinion, PCT/US2010/038707, Dec. 16, 2010, 17 Pages.

Invitation to Pay Additional Fees and, Where Applicable, Protest Fee, PCT/US2010/038707, Oct. 14, 2010, 2 pages.

PCT International Search Report and Written Opinion, PCT/US2010/038679, Aug. 30, 2010, 9 Pages.

PCT International Search Report and Written Opinion, PCT/US2010/047726, Dec. 13, 2010, 17 Pages.

International Search Report and the Written Opinion for PCT/US07/68655 dated Oct. 29, 2007, 15 pages.

PCT Invitation to Pay Additional Fees and, Where Applicable, Protest Fee, PCT/US2009/032743, Sep. 17, 2009, 2 Pages.

PCT International Search Report and Written Opinion, PCT/US2009/032743, Dec. 10, 2009, 10 Pages.

Examination Report for Australia Patent Application No. 572666, Sep. 21, 2010, 2 pages.

Examination Report for Australia Patent Application No. 572666, Jun. 1, 2010, 9 pages.

Examination Report for New Zealand Patent Application No. 587616, Sep. 1, 2010, 2 pages.

Notice of Preliminary Rejection for Korea Patent Application No. 10-2008-7030164, Aug. 13, 2010, 11 pages.

Supplementary European Search Report, EP 07762085, Sep. 25, 2009, 11 Pages.

European Search Report, European Patent Application No. EP 09015323.0, Apr. 28, 2010, 7 Pages.

Official Action for Eurasian Patent Application No. 200870528, Oct. 4, 2010, 3 pages.

Downward, J., "Science, medicine, and the future RNA Interference," Clinical Review, BMJ, May 22, 2004, pp. 1245-1248, vol. 328.

Taylor, N., et al., "Curbing activation: proprotein convertases in homeostasis and pathology," The FASEB Journal, Jul. 2003, pp. 1215-1227, vol. 17.

Hayes, M.E., et al., "Genospheres: Self-assembling nucleic acid-lipid nanoparticles suitable for targeted gene delivery," Gene Therapy, 2005, 13:646-651.

International Search Report issued in PCT/US10/38224 on Sep. 27, 2010, 1 page.

\* cited by examiner

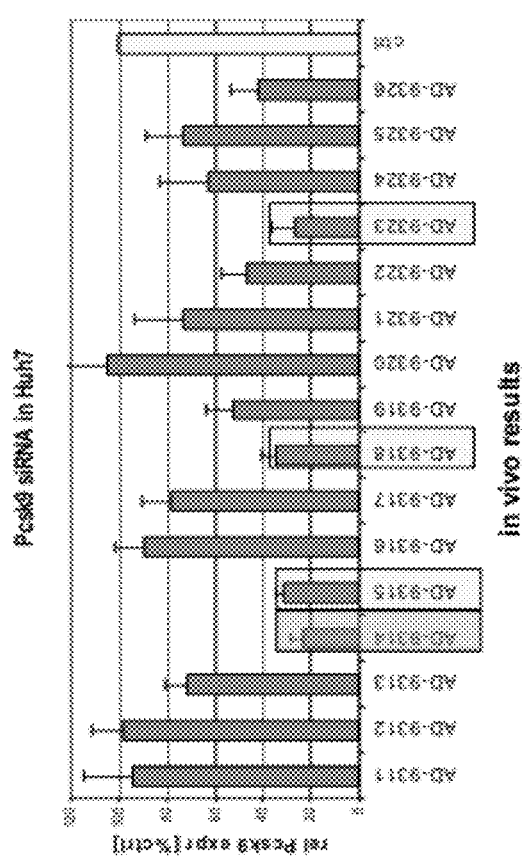
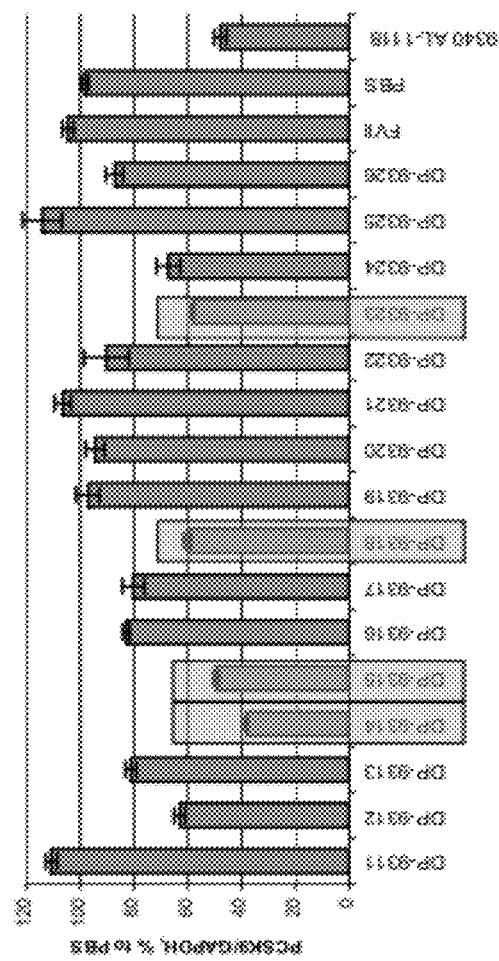
FIG. 6A
FIG. 6B

= P<.01; * = P<.001 (ANOVA)

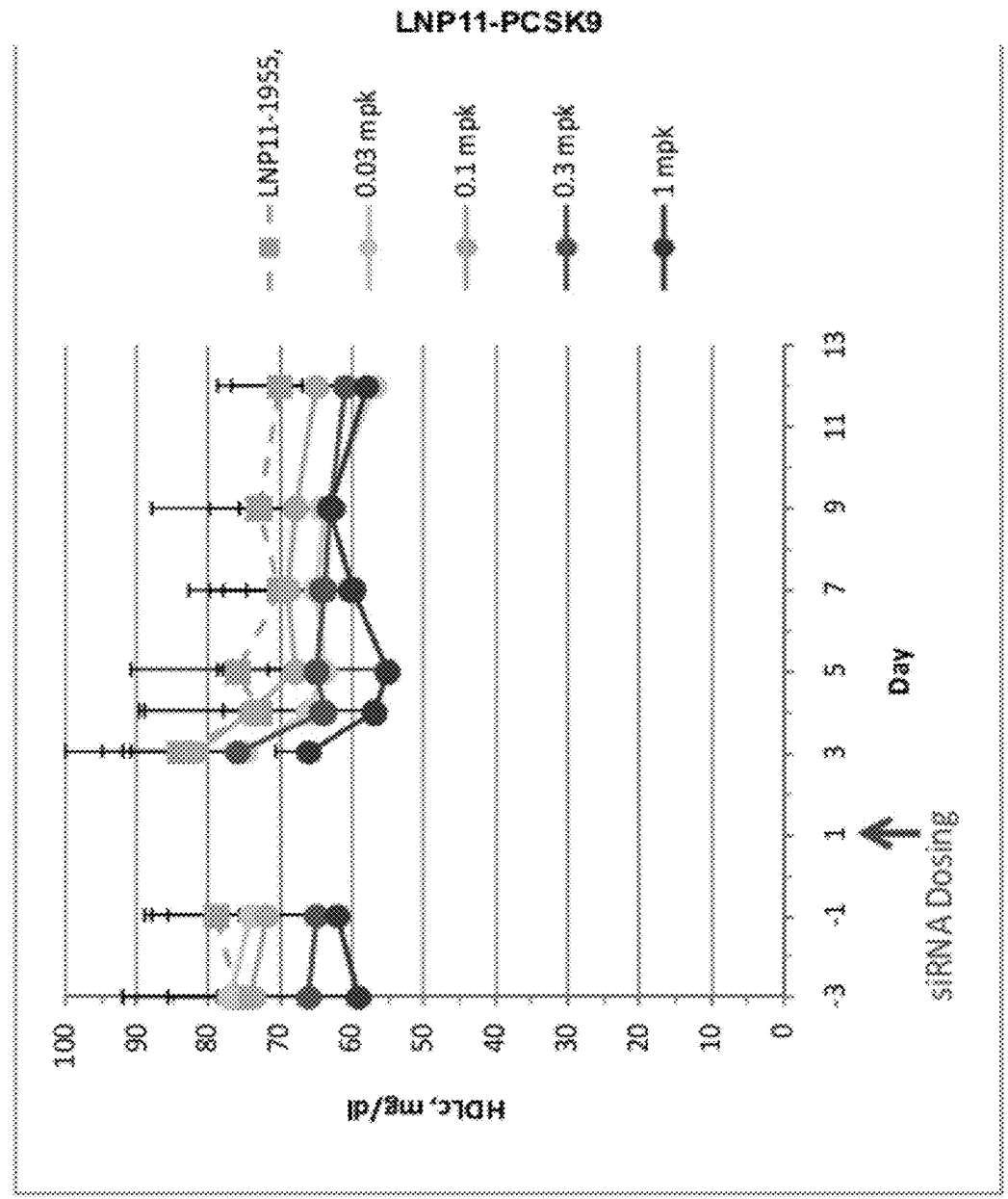

LIPID FORMULATED DSRNA TARGETING THE PCSK9 GENE

CROSS REFERENCE TO RELATED APPLICATIONS

This application claims the benefit of U.S. Provisional Application Ser. No. 61/187,169, filed Jun. 15, 2009; and U.S. Provisional Application Ser. No. 61/218,350, filed Jun. 18, 2009; and U.S. Provisional Application Ser. No. 61/244,790, filed Sep. 22, 2009; and U.S. Provisional Application Ser. No. 61/285,598, filed Dec. 11, 2009; and U.S. Provisional Application Ser. No. 61/293,474, filed Jan. 8, 2010; and U.S. Provisional Application Ser. No. 61/313,578, filed Mar. 12, 2010, all of which are incorporated herein by reference, in their entirety, for all purposes.

FIELD OF THE INVENTION

This invention relates to compositions comprising lipid formulated dsRNA targeting a PCSK9 gene and methods for treating diseases caused by PCSK9 gene expression.

REFERENCE TO A SEQUENCE LISTING

This application includes a Sequence Listing submitted electronically as a text file named 16733US_sequencelisting.txt, created on Jul. 26, 2010, with a size of 567,360 bytes. The sequence listing is incorporated by reference.

BACKGROUND OF THE INVENTION

Proprotein convertase subtilisin kexin 9 (PCSK9) is a member of the subtilisin serine protease family. The other eight mammalian subtilisin proteases, PCSK1-PCSK8 (also called PC1/3, PC2, furin, PC4, PC5/6, PACE4, PC7, and S1P/SKI-1) are proprotein convertases that process a wide variety of proteins in the secretory pathway and play roles in diverse biological processes (Bergeron, F. (2000) *J. Mol. Endocrinol.* 24, 1-22, Gensberg, K., (1998) *Semin. Cell Dev. Biol.* 9, 11-17, Seidah, N. G. (1999) *Brain Res.* 848, 45-62, Taylor, N. A., (2003) *FASEB J.* 17, 1215-1227, and Zhou, A., (1999) *J. Biol. Chem.* 274, 20745-20748). PCSK9 has been proposed to play a role in cholesterol metabolism. PCSK9 mRNA expression is down-regulated by dietary cholesterol feeding in mice (Maxwell, K. N., (2003) *J. Lipid Res.* 44, 2109-2119), up-regulated by statins in HepG2 cells (Dubuc, G., (2004) *Arterioscler. Thromb. Vasc. Biol.* 24, 1454-1459), and up-regulated in sterol regulatory element binding protein (SREBP) transgenic mice (Horton, J. D., (2003) *Proc. Natl. Acad. Sci. USA* 100, 12027-12032), similar to the cholesterol biosynthetic enzymes and the low-density lipoprotein receptor (LDLR). Furthermore, PCSK9 missense mutations have been found to be associated with a form of autosomal dominant hypercholesterolemia (Hchola3) (Abifadel, M., et al. (2003) *Nat. Genet.* 34, 154-156, Timms, K. M., (2004) *Hum. Genet.* 114, 349-353, Leren, T. P. (2004) *Clin. Genet.* 65, 419-422). PCSK9 may also play a role in determining LDL cholesterol levels in the general population, because single-nucleotide polymorphisms (SNPs) have been associated with cholesterol levels in a Japanese population (Shioji, K., (2004) *J. Hum. Genet.* 49, 109-114).

Autosomal dominant hypercholesterolemias (ADHs) are monogenic diseases in which patients exhibit elevated total and LDL cholesterol levels, tendon xanthomas, and premature atherosclerosis (Rader, D. J., (2003) *J. Clin. Invest.* 111, 1795-1803). The pathogenesis of ADHs and a recessive form, autosomal recessive hypercholesterolemia (ARH) (Cohen, J. C., (2003) *Curr. Opin. Lipidol.* 14, 121-127), is due to defects in LDL uptake by the liver. ADH may be caused by LDLR mutations, which prevent LDL uptake, or by mutations in the protein on LDL, apolipoprotein B, which binds to the LDLR. ARH is caused by mutations in the ARH protein that are necessary for endocytosis of the LDLR-LDL complex via its interaction with clathrin. Therefore, if PCSK9 mutations are causative in Hchola3 families, it seems likely that PCSK9 plays a role in receptor-mediated LDL uptake.

Overexpression studies point to a role for PCSK9 in controlling LDLR levels and, hence, LDL uptake by the liver (Maxwell, K. N. (2004) *Proc. Natl. Acad. Sci. USA* 101, 7100-7105, Benjannet, S., et al. (2004) *J. Biol. Chem.* 279, 48865-48875, Park, S. W., (2004) *J. Biol. Chem.* 279, 50630-50638). Adenoviral-mediated overexpression of mouse or human PCSK9 for 3 or 4 days in mice results in elevated total and LDL cholesterol levels; this effect is not seen in LDLR knockout animals (Maxwell, K. N. (2004) *Proc. Natl. Acad. Sci. USA* 101, 7100-7105, Benjannet, S., et al. (2004) *J. Biol. Chem.* 279, 48865-48875, Park, S. W., (2004) *J. Biol. Chem.* 279, 50630-50638). In addition, PCSK9 overexpression results in a severe reduction in hepatic LDLR protein, without affecting LDLR mRNA levels, SREBP protein levels, or SREBP protein nuclear to cytoplasmic ratio.

Loss of function mutations in PCSK9 have been designed in mouse models (Rashid et al., (2005) *PNAS*, 102, 5374-5379), and identified in human individuals (Cohen et al. (2005) *Nature Genetics* 37:161-165). In both cases loss of PCSK9 function lead to lowering of total and LDLc cholesterol. In a retrospective outcome study over 15 years, loss of one copy of PCSK9 was shown to shift LDLc levels lower and to lead to an increased risk-benefit protection from developing cardiovascular heart disease (Cohen et al., (2006) *N. Engl. J. Med.*, 354:1264-1272).

Recently, double-stranded RNA molecules (dsRNA) have been shown to block gene expression in a highly conserved regulatory mechanism known as RNA interference (RNAi). WO 99/32619 (Fire et al.) discloses the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

A description of siRNA targeting PCSK9 can be found in U.S. Pat. No. 7,605,251 and WO 2007/134161. Additional disclosure can be found in U.S. Patent Publication No. 2010/0010066 and WO 2009/134487

SUMMARY OF THE INVENTION

As described in more detail below, disclosed herein are compositions comprising lipid formulated siRNA targeting PCSK9, e.g., MC3 formulated siRNA targeting PCSK9. Also disclosed are methods of using the compositions for inhibition of PCSK9 expression and for treatment of pathologies related to PCSK9 expression, e.g., hyperlipidemia Accordingly, one aspect of the invention is a compositing comprising a nucleic acid lipid particle comprising a double-stranded ribonucleic acid (dsRNA) for inhibiting the expression of a human PCSK9 gene in a cell, wherein the nucleic acid lipid particle comprises a lipid formulation comprising 45-65 mol % of a cationic lipid, 5 mol % to about 10 mol %, of a non-cationic lipid, 25-40 mol % of a sterol, and 0.5-5 mol % of a PEG or PEG-modified lipid, the dsRNA consists of a sense strand and an antisense strand, and the sense strand comprises a first sequence and the antisense strand comprises a second sequence complementary to at least 15 contiguous nucleotides of SEQ ID NO:1523 (5'-UUCUAGACCUGU-UUUGCUU-3'), wherein the first sequence is complementary to the second sequence and wherein the dsRNA is between 15 and 30 base pairs in length.

As described herein the composition includes a cationic lipid. In one embodiment, the cationic lipid comprises MC3 (((6Z,9Z,28Z,31Z)-heptatriaconta-6,9,28,31-tetraen-19-yl 4-(dimethylamino)butanoate. For example, the lipid formulation can be selected from the following:

| LNP11 | MC3/DSPC/Cholesterol/PEG-DMG 50/10/38.5/1.5 |
| LNP14 | MC3/DSPC/Cholesterol/PEG-DMG 40/15/40/5 |
| LNP15 | MC3/DSPC/Cholesterol/PEG-DSG/GalNAc-PEG-DSG 50/10/35/4.5/0.5 |
| LNP16 | MC3/DSPC/Cholesterol/PEG-<u>DMG</u> 50/10/38.5/1.5 |
| LNP17 | MC3/DSPC/Cholesterol/PEG-DSG 50/10/38.5/1.5 |
| LNP18 | MC3/DSPC/Cholesterol/PEG-DMG 50/10/38.5/1.5 |
| LNP19 | MC3/DSPC/Cholesterol/PEG-DMG 50/10/35/5 |
| LNP20 | MC3/DSPC/Cholesterol/PEG-DPG 50/10/38.5/1.5 |

In other embodiments, the cationic lipid comprises formula A wherein formula A is

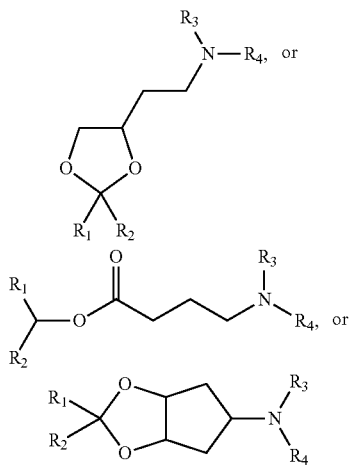

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments the cationic lipid comprises formula A and is XTC (2,2-Dilinoleyl-4-dimethylaminoethyl-[1,3]-dioxolane). The lipid formulation can include the cationic lipid XTC, the non-cationic lipid DSPC, the sterol cholesterol and the PEG lipid PEG-DMG. In other embodiments the cationic lipid comprises XTC and the formulation is selected from the group consisting of:

| LNP05 | XTC/DSPC/Cholesterol/PEG-DMG 57.5/7.5/31.5/3.5 |
| LNP06 | XTC/DSPC/Cholesterol/PEG-DMG 57.5/7.5/31.5/3.5 |
| LNP07 | XTC/DSPC/Cholesterol/PEG-DMG 60/7.5/31/1.5, |
| LNP08 | XTC/DSPC/Cholesterol/PEG-DMG 60/7.5/31/1.5 |
| LNP09 | XTC/DSPC/Cholesterol/PEG-DMG 50/10/38.5/1.5 |
| LNP13 | XTC/DSPC/Cholesterol/PEG-DMG 50/10/38.5/1.5 |
| LNP22 | XTC/DSPC/Cholesterol/PEG-DSG 50/10/38.5/1.5 |

In still further embodiments, the cationic lipid comprises ALNY-100 ((3aR,5s,6aS)-N,N-dimethyl-2,2-di((9Z,12Z)-octadeca-9,12-dienyl)tetrahydro-3aH-cyclopenta[d][1,3]dioxol-5-amine)). For example, the cationic lipid comprises ALNY-100 and the formulation consists of ALNY-100/DSPC/Cholesterol/PEG-DMG in a ratio of 50/10/38.5/1.5

The composition includes a dsRNA targeting PCSK9. In some embodiments, the sense strand comprises SEQ ID NO:1227 and the antisense strand comprises SEQ ID NO:1228. In other embodiments, the sense strand consists of SEQ ID NO:1227 and the antisense strand consists of SEQ ID NO:1228. One or both strands can be modified, e.g., each strand is modified as follows to include a 2'-O-methyl ribonucleotide as indicated by a lower case letter "c" or "u" and a phosphorothioate as indicated by a lower case letter "s": the dsRNA consists of a sense strand consisting of SEQ ID NO: 1229    (5'-uucuAGAccuGuuuuGcuuTsT-3')

and an antisense strand consisting of

SEQ ID NO: 1230    (5'-AAGcAAAAcAGGUCuAGAATsT-3').

In other embodiments, the dsRNA comprises at least one modified nucleotide, e.g., a modified nucleotide chosen from the group of: a 2'-O-methyl modified nucleotide, a nucleotide comprising a 5'-phosphorothioate group, and a terminal nucleotide linked to a cholesteryl derivative or dodecanoic acid bisdecylamide group, and/or, e.g., the modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. In one embodiment, dsRNA comprises at least one 2'-O-methyl modified ribonucleotide and at least one nucleotide comprising a 5'-phosphorothioate group.

The compositions include a dsRNA between 15 and 30 base pairs in length. In one embodiment, each strand of the dsRNA is 19-23 bases in length, or, e.g., 21-23 bases in length, or, e.g. 21 bases in length.

In one aspect, the compositions include a lipoprotein, e.g., apolipoprotein E (ApoE). In some embodiments, the compositions include a lipoprotein and the dsRNA is conjugated to a lipophile, e.g., a cholesterol. The ApoE can be reconstituted with at least one amphiphilic agent, e.g., a phospholipid, e.g., a phospholipid selected from the group consisting of dimyristoyl phosphatidyl choline (DMPC), dioleoylphosphatidylethanolamine (DOPE), palmitoyloleoylphosphatidylcholine (POPC), egg phosphatidylcholine (EPC), distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), -phosphatidylethanolamine (POPE), dioleoyl-phosphatidylethanolamine 4-(N-maleimidomethyl)-cyclohexane-1-carboxylate (DOPE-mal), and combinations thereof. In some embodiments, the ApoE is reconstituted high density lipoprotein (rHDL).

The compositions, e.g., lipid formulated dsRNA targeting PCSK9, can be administered to a cell or subject, e.g., a primate, e.g., a human. In one aspect, administration of the compositions inhibits expression of PCSK9 by at least 40% compared to administration of a control and/or reduces PCSK9 protein levels in the mammal compared to administration of a control, and/or reduces LDLc levels in a mammal compared to administration of a control and/or reduces both PCSK9 hepatic mRNA and total serum cholesterol at a dosage of less than 0.1 mg/kg compared to administration of a control and/or reduces PCSK9 hepatic mRNA at an ED50 of about 0.2 mg/kg and reduces total serum cholesterol with an ED50 of about 0.08 mg/kg compared to administration of a control and/or reduces serum LDL particle numbers by more than 90% or reduces serum HDL particle numbers by more than 75% compared to administration of a control.

The invention also provides methods comprising administering the lipid formulated PCSK9 targeted dsRNA compositions described herein. In one embodiment, the invention includes a method for inhibiting the expression of PCSK9 in a cell comprising administering the compositions to the cell. In another embodiment, the invention includes a method for reducing LDLc levels in a mammal in need of treatment comprising administering the compositions to the mammal.

As described in more detail below, the methods can include any appropriate dosage, e.g., between 0.25 mg/kg and 4 mg/kg dsRNA, or e.g., at about 0.01, 0.1, 0.5, 1.0, 2.5, or 5.0 mg/kg dsRNA.

Also described herein are methods for inhibiting expression of a PCSK9 gene in a subject, comprising administering to the subject the lipid formulated PCSK9 targeted dsRNA compositions described herein at a first dose of about 3 mg/kg followed by administering at least one subsequent dose once a week, wherein the subsequent dose is lower than the first dose. The subject can be, e.g., a rat or a non-human primate or a human. The subsequent dose can be about 1.0 mg/kg or about 0.3 mg/kg. In some embodiments, the subsequent dose is administered once a week for four weeks. In some embodiments, administration of the first dose decreases total cholesterol levels by about 15-60%.

The details of one or more embodiments of the invention are set forth in the accompanying drawings and the description below. Other features, objects, and advantages of the invention will be apparent from the description and drawings, and from the claims.

BRIEF DESCRIPTION OF THE DRAWINGS

The prefixes "AD-" "DP-" and "AL-DP-" are used interchangeably e.g., AL-DP-9327 and AD-9237.

FIGS. 6A and 6B compare in vitro and in vivo results, respectively, for silencing PCSK9.

FIG. 27C is a graph with the results of administration of second generation LNP formulated PCSK9 targeted siRNA (AD-9680) to non-human primates, demonstrating a no change in HDLc levels.

DETAILED DESCRIPTION OF THE INVENTION

Figure 1:
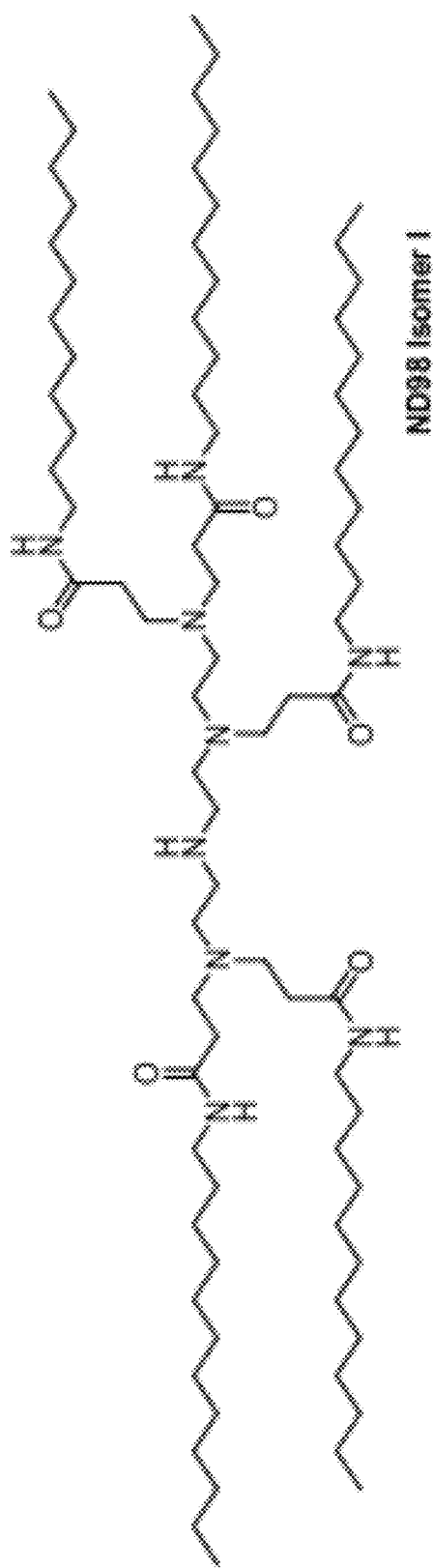
FIG. 1 shows the structure of the ND-98 lipid.

The invention provides a solution to the problem of treating diseases that can be modulated by the down regulation of the PCSK9 gene, such as hyperlipidemia, by using double-stranded ribonucleic acid (dsRNA) to silence the PCSK9 gene.

The invention provides compositions and methods for inhibiting the expression of the PCSK9 gene in a subject using a dsRNA. The invention also provides compositions and methods for treating pathological conditions and diseases, such as hyperlipidemia, that can be modulated by down regulating the expression of the PCSK9 gene. dsRNA directs the sequence-specific degradation of mRNA through a process known as RNA interference (RNAi).

The dsRNA useful for the compositions and methods of an invention include an RNA strand (the antisense strand) having a region that is less than 30 nucleotides in length, generally 19-24 nucleotides in length, and is substantially complementary to at least part of an mRNA transcript of the PCSK9 gene. The use of these dsRNAs enables the targeted degradation of an mRNA that is involved in the regulation of the LDL Receptor and circulating cholesterol levels. Using cell-based and animal assays, the present inventors have demonstrated that very low dosages of these dsRNAs can specifically and efficiently mediate RNAi, resulting in significant inhibition of expression of the PCSK9 gene. Thus, methods and compositions including these dsRNAs are useful for treating pathological processes that can be mediated by down regulating PCSK9, such as in the treatment of hyperlipidemia.

The following detailed description discloses how to make and use the dsRNA and compositions containing dsRNA to inhibit the expression of the target PCSK9 gene, as well as compositions and methods for treating diseases that can be modulated by down regulating the expression of PCSK9, such as hyperlipidemia. The pharmaceutical compositions of the invention include a dsRNA having an antisense strand having a region of complementarity that is less than 30 nucleotides in length, generally 19-24 nucleotides in length, and that is substantially complementary to at least part of an RNA transcript of the PCSK9 gene, together with a pharmaceutically acceptable carrier.

Accordingly, certain aspects of the invention provide pharmaceutical compositions including the dsRNA that targets PCSK9 together with a pharmaceutically acceptable carrier, methods of using the compositions to inhibit expression of the PCSK9 gene, and methods of using the pharmaceutical compositions to treat diseases by down regulating the expression of PCSK9.

Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine. However, it will be understood that the term "ribonucleotide" or "nucleotide" or "deoxyribonucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "PCSK9" refers to the proprotein convertase subtilisin kexin 9 gene or protein (also known as FH3, HCHOLA3, NARC-1, NARC1). Examples of mRNA sequences to PCSK9 include but are not limited to the following: human: NM_174936; mouse: NM_153565, and rat: NM_199253. Additional examples of PCSK9 mRNA sequences are readily available using, e.g., GenBank.

As used herein, "target sequence" refers to a contiguous portion of the nucleotide sequence of an mRNA molecule formed during the transcription of the PCSK9 gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide having the first nucleotide sequence to the oligonucleotide or polynucleotide having the second nucleotide sequence over the entire length of the first and second nucleotide sequences. Such sequences can be referred to as "fully complementary" with respect to each other. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA having one oligonucleotide 21 nucleotides in length and another oligonucleotide 23 nucleotides in length, wherein the longer oligonucleotide has a sequence of 21 nucleotides that is fully complementary to the shorter oligonucleotide, may yet be referred to as "fully complementary."

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary", "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide that is substantially complementary to a contiguous portion of the mRNA of interest (e.g., encoding PCSK9) including a 5' UTR, an open reading frame (ORF), or a 3' UTR. For example, a polynucleotide is complementary to at least a part of a PCSK9 mRNA if the sequence is substantially complementary to a non-interrupted portion of an mRNA encoding PCSK9.

The term "double-stranded RNA" or "dsRNA", as used herein, refers a duplex structure comprising two anti-parallel and substantially complementary, as defined above, nucleic acid strands. In general, the majority of nucleotides of each strand are ribonucleotides, but as described in detail herein, each or both strands can also include at least one non-ribonucleotide, e.g., a deoxyribonucleotide and/or a modified nucleotide. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims.

The two strands forming the duplex structure may be different portions of one larger RNA molecule, or they may be separate RNA molecules. Where separate RNA molecules, such dsRNA are often referred to in the literature as siRNA ("short interfering RNA"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In general, the majority of nucleotides of each strand are ribonucleotides, but as described in detail herein, each or both strands can also include at least one non-ribonucleotide, e.g., a deoxyribonucleotide and/or a modified nucleotide. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule. For clarity, chemical caps or non-nucleotide chemical moieties conjugated to the 3' end or 5' end of an siRNA are not considered in determining whether an siRNA has an overhang or is blunt ended.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally the most tolerated mismatches are in the terminal regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

"Introducing into a cell", when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell", wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence," "inhibit the expression of," "down-regulate the expression of," "suppress the expression of," and the like, in as far as they refer to the PCSK9 gene, herein refer to the at least partial suppression of the expression of the PCSK9 gene, as manifested by a reduction of the amount of PCSK9 mRNA which may be isolated from a first cell or group of cells in which the PCSK9 gene is transcribed and which has or have been treated such that the expression of the PCSK9 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to PCSK9 gene expression, e.g. the amount of protein encoded by the PCSK9 gene which is produced by a cell, or the number of cells displaying a certain phenotype. In principle, target gene silencing can be determined in any cell expressing the target, either constitutively or by genomic engineering, and by any appropriate assay. However, when a reference is needed in order to determine whether a given dsRNA inhibits the expression of the PCSK9 gene by a certain degree and therefore is encompassed by the instant invention, the assays provided in the Examples below shall serve as such reference.

As used herein in the context of PCSK9 expression, the terms "treat", "treatment", and the like, refer to relief from or alleviation of pathological processes which can be mediated by down regulating the PCSK9 gene. In the context of the present invention insofar as it relates to any of the other conditions recited herein below (other than pathological processes which can be mediated by down regulating the PCSK9 gene), the terms "treat", "treatment", and the like mean to relieve or alleviate at least one symptom associated with such condition, or to slow or reverse the progression of such condition. For example, in the context of hyperlipidemia, treatment will involve a decrease in serum lipid levels.

As used herein, the phrases "therapeutically effective amount" and "prophylactically effective amount" refer to an amount that provides a therapeutic benefit in the treatment, prevention, or management of pathological processes that can be mediated by down regulating the PCSK9 gene or an overt symptom of pathological processes which can be mediated by down regulating the PCSK9 gene. The specific amount that is therapeutically effective can be readily determined by an ordinary medical practitioner, and may vary depending on factors known in the art, such as, e.g., the type of pathological processes that can be mediated by down regulating the PCSK9 gene, the patient's history and age, the stage of pathological processes that can be mediated by down regulating PCSK9 gene expression, and the administration of other anti-pathological processes that can be mediated by down regulating PCSK9 gene expression.

As used herein, a "pharmaceutical composition" includes a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof and are described in more detail below. The term specifically excludes cell culture medium.

As used herein, a "transformed cell" is a cell into which a vector has been introduced from which a dsRNA molecule may be expressed.

Double-Stranded Ribonucleic Acid (dsRNA)

As described in more detail below, the invention provides methods and composition having double-stranded ribonucleic acid (dsRNA) molecules for inhibiting the expression of the PCSK9 gene in a cell or mammal, wherein the dsRNA includes an antisense strand having a region of complementarity that is complementary to at least a part of an mRNA formed in the expression of the PCSK9 gene, and wherein the region of complementarity is less than 30 nucleotides in length, generally 19-24 nucleotides in length. In some embodiments, the dsRNA, upon contact with a cell expressing the PCSK9 gene, inhibits the expression of said PCSK9 gene, e.g., as measured such as by an assay described herein. For example, expression of a PCSK9 gene in cell culture, such as in HepB3 cells, can be assayed by measuring PCSK9 mRNA levels, such as by bDNA or TaqMan assay, or by measuring protein levels, such as by ELISA assay. The dsRNA of the invention can further include one or more single-stranded nucleotide overhangs.

The dsRNA can be synthesized by standard methods known in the art as further discussed below, e.g., by use of an automated DNA synthesizer, such as are commercially available from, for example, Biosearch, Applied Biosystems, Inc. The dsRNA includes two nucleic acid strands that are sufficiently complementary to hybridize to form a duplex structure. One strand of the dsRNA (the antisense strand) can have a region of complementarity that is substantially complementary, and generally fully complementary, to a target sequence, derived from the sequence of an mRNA formed during the expression of the PCSK9 gene. The other strand (the sense strand) includes a region that is complementary to the antisense strand, such that the two strands hybridize and form a duplex structure when combined under suitable conditions. Generally, the duplex structure is between 15 and 30, or between 25 and 30, or between 18 and 25, or between 19 and 24, or between 19 and 21, or 19, 20, or 21 base pairs in length. In one embodiment the duplex is 19 base pairs in length. In another embodiment the duplex is 21 base pairs in length. When two different siRNAs are used in combination, the duplex lengths can be identical or can differ.

Each strand of the dsRNA of invention is generally between 15 and 30, or between 18 and 25, or 18, 19, 20, 21, 22, 23, 24, or 25 nucleotides in length. In other embodiments, each is strand is 25-30 nucleotides in length. Each strand of the duplex can be the same length or of different lengths. When two different siRNAs are used in combination, the lengths of each strand of each siRNA can be identical or can differ.

The dsRNA of the invention can include one or more single-stranded overhang(s) of one or more nucleotides. In one embodiment, at least one end of the dsRNA has a single-stranded nucleotide overhang of 1 to 4, generally 1 or 2 nucleotides. In another embodiment, the antisense strand of the dsRNA has 1-10 nucleotides overhangs each at the 3' end and the 5' end over the sense strand. In further embodiments, the sense strand of the dsRNA has 1-10 nucleotides overhangs each at the 3' end and the 5' end over the antisense strand.

A dsRNAs having at least one nucleotide overhang can have unexpectedly superior inhibitory properties than the blunt-ended counterpart. In some embodiments the presence of only one nucleotide overhang strengthens the interference activity of the dsRNA, without affecting its overall stability. A dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA can also have a blunt end, generally located at the 5'-end of the antisense strand. Such dsRNAs can have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

The dsRNA can be synthesized by standard methods known in the art as further discussed below, e.g., by use of an automated DNA synthesizer, such as are commercially available from, for example, Biosearch, Applied Biosystems, Inc. In one embodiment, the PCSK9 gene is a human PCSK9 gene. In other embodiments, the antisense strand of the dsRNA includes a first strand selected from the sense sequences of Table 1a, Table 2a, and Table 5a, and a second strand selected from the antisense sequences of Table 1a, Table 2a, and Table 5a. Alternative antisense agents that target elsewhere in the target sequence provided in Table 1a, Table 2a, and Table 5a, can readily be determined using the target sequence and the flanking PCSK9 sequence.

For example, the dsRNA AD-9680 (from Table 1a) targets the PCSK 9 gene at 3530-3548; therefore the target sequence is as follows: 5' UUCUAGACCUGUUUUGCUU 3' (SEQ ID NO:1523). The dsRNA AD-10792 (from Table 1a) targets the PCSK9 gene at 1091-1109; therefore the target sequence is as follows: 5' GCCUGGAGUUUAUUCGGAA 3' (SEQ ID NO:1524). Included in the invention are dsRNAs that have regions of complementarity to SEQ ID NO:1523 and SEQ ID NO:1524.

In further embodiments, the dsRNA includes at least one nucleotide sequence selected from the groups of sequences provided in Table 1a, Table 2a, and Table 5a. In other embodiments, the dsRNA includes at least two sequences selected from this group, where one of the at least two sequences is complementary to another of the at least two sequences, and one of the at least two sequences is substantially complementary to a sequence of an mRNA generated in the expression of the PCSK9 gene. Generally, the dsRNA includes two oligonucleotides, where one oligonucleotide is described as the sense strand in Table 1a, Table 2a, and Table 5a and the second oligonucleotide is described as the antisense strand in Table 1a, Table 2a, and Table 5a The skilled person is well aware that dsRNAs having a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Table 1a, Table 2a, and Table 5a, the dsRNAs of the invention can include at least one strand of a length of minimally 21 nt. It can be reasonably expected that shorter dsRNAs having one of the sequences of Table 1a, Table 2a, and Table 5a minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 1a, Table 2a, and Table 5a, and differing in their ability to inhibit the expression of the PCSK9 gene in a FACS assay as described herein below by not more than 5, 10, 15, 20, 25, or 30% inhibition from a dsRNA comprising the full sequence, are contemplated by the invention. Further dsRNAs that cleave within the target sequence provided in Table 1a, Table 2a, and Table 5a can readily be made using the PCSK9 sequence and the target sequence provided.

In addition, the RNAi agents provided in Table 1a, Table 2a, and Table 5a identify a site in the PCSK9 mRNA that is susceptible to RNAi based cleavage. As such the present invention further includes RNAi agents that target within the sequence targeted by one of the agents of the present invention. As used herein a second RNAi agent is said to target within the sequence of a first RNAi agent if the second RNAi agent cleaves the message anywhere within the mRNA that is complementary to the antisense strand of the first RNAi agent. Such a second agent will generally consist of at least 15 contiguous nucleotides from one of the sequences provided in Table 1a, Table 2a, and Table 5a coupled to additional nucleotide sequences taken from the region contiguous to the selected sequence in the PCSK9 gene. For example, the last 15 nucleotides of SEQ ID NO:1 (minus the added AA sequences) combined with the next 6 nucleotides from the target PCSK9 gene produces a single strand agent of 21 nucleotides that is based on one of the sequences provided in Table 1a, Table 2a, and Table 5a.

The dsRNA of the invention can contain one or more mismatches to the target sequence. In one embodiment, the dsRNA of the invention contains no more than 1, no more than 2, or no more than 3 mismatches. In one embodiment, the antisense strand of the dsRNA contains mismatches to the target sequence, and the area of mismatch is not located in the center of the region of complementarity. In another embodiment, the antisense strand of the dsRNA contains mismatches to the target sequence and the mismatch is restricted to 5 nucleotides from either end, for example 5, 4, 3, 2, or 1 nucleotide from either the 5' or 3' end of the region of complementarity. For example, for a 23 nucleotide dsRNA strand which is complementary to a region of the PCSK9 gene, the dsRNA does not contain any mismatch within the central 13 nucleotides. The methods described within the invention can be used to determine whether a dsRNA containing a mismatch to a target sequence is effective in inhibiting the expression of the PCSK9 gene. Consideration of the efficacy of dsRNAs with mismatches in inhibiting expression of the PCSK9 gene is important, especially if the particular region of complementarity in the PCSK9 gene is known to have polymorphic sequence variation within the population.

In one embodiment, at least one end of the dsRNA has a single-stranded nucleotide overhang of 1 to 4, generally 1 or 2 nucleotides. dsRNAs having at least one nucleotide overhang have unexpectedly superior inhibitory properties than their blunt-ended counterparts. Moreover, the present inventors have discovered that the presence of only one nucleotide overhang strengthens the interference activity of the dsRNA, without affecting its overall stability. dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA may also have a blunt end, generally located at the 5'-end of the antisense strand. Such dsRNAs have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

Chemical Modifications and Conjugates

In yet another embodiment, the dsRNA is chemically modified to enhance stability. The nucleic acids of the invention may be synthesized and/or modified by methods well established in the art, such as those described in "Current protocols in nucleic acid chemistry", Beaucage, S. L. et al. (Edrs.), John Wiley & Sons, Inc., New York, N.Y., USA, which is hereby incorporated herein by reference. Chemical modifications may include, but are not limited to 2' modifications, modifications at other sites of the sugar or base of an oligonucleotide, introduction of non-natural bases into the oligonucleotide chain, covalent attachment to a ligand or chemical moiety, and replacement of internucleotide phosphate linkages with alternate linkages such as thiophosphates. More than one such modification may be employed.

Chemical linking of the two separate dsRNA strands may be achieved by any of a variety of well-known techniques, for example by introducing covalent, ionic or hydrogen bonds; hydrophobic interactions, van der Waals or stacking interactions; by means of metal-ion coordination, or through use of purine analogues. Generally, the chemical groups that can be used to modify the dsRNA include, without limitation, methylene blue; bifunctional groups, generally bis-(2-chloroethyl) amine; N-acetyl-N'-(p-glyoxylbenzoyl)cystamine; 4-thiouracil; and psoralen. In one embodiment, the linker is a hexaethylene glycol linker. In this case, the dsRNA are produced by solid phase synthesis and the hexa-ethylene glycol linker is incorporated according to standard methods (e.g., Williams, D. J., and K. B. Hall, *Biochem.* (1996) 35:14665-14670). In a particular embodiment, the 5'-end of the antisense strand and the 3'-end of the sense strand are chemically linked via a hexaethylene glycol linker. In another embodiment, at least one nucleotide of the dsRNA comprises a phosphorothioate or phosphorodithioate groups. The chemical bond at the ends of the dsRNA is generally formed by triple-helix bonds. Table 1a, Table 2a, and Table 5a provides examples of modified RNAi agents of the invention.

In yet another embodiment, the nucleotides at one or both of the two single strands may be modified to prevent or inhibit the degradation activities of cellular enzymes, such as, for example, without limitation, certain nucleases. Techniques for inhibiting the degradation activity of cellular enzymes against nucleic acids are known in the art including, but not limited to, 2'-amino modifications, 2'-amino sugar modifications, 2'-F sugar modifications, 2'-F modifications, 2'-alkyl sugar modifications, uncharged backbone modifications, morpholino modifications, 2'-O-methyl modifications, and phosphoramidate (see, e.g., Wagner, *Nat. Med.* (1995) 1:1116-8). Thus, at least one 2'-hydroxyl group of the nucleotides on a dsRNA is replaced by a chemical group, generally by a 2'-amino or a 2'-methyl group. Also, at least one nucleotide may be modified to form a locked nucleotide. Such locked nucleotide contains a methylene bridge that connects the 2'-oxygen of ribose with the 4'-carbon of ribose. Oligonucleotides containing the locked nucleotide are described in Koshkin, A. A., et al., *Tetrahedron* (1998), 54: 3607-3630) and Obika, S. et al., *Tetrahedron Lett.* (1998), 39: 5401-5404). Introduction of a locked nucleotide into an oligonucleotide improves the affinity for complementary sequences and increases the melting temperature by several degrees (Braasch, D. A. and D. R. Corey, *Chem. Biol.* (2001), 8:1-7).

Conjugating a ligand to a dsRNA can enhance its cellular absorption as well as targeting to a particular tissue or uptake by specific types of cells such as liver cells. In certain instances, a hydrophobic ligand is conjugated to the dsRNA to facilitate direct permeation of the cellular membrane and or uptake across the liver cells. Alternatively, the ligand conjugated to the dsRNA is a substrate for receptor-mediated endocytosis. These approaches have been used to facilitate cell permeation of antisense oligonucleotides as well as dsRNA agents. For example, cholesterol has been conjugated to various antisense oligonucleotides resulting in compounds that are substantially more active compared to their non-conjugated analogs. See M. Manoharan *Antisense & Nucleic Acid Drug Development* 2002, 12, 103. Other lipophilic compounds that have been conjugated to oligonucleotides include 1-pyrene butyric acid, 1,3-bis-O-(hexadecyl)glycerol, and menthol. One example of a ligand for receptor-mediated endocytosis is folic acid. Folic acid enters the cell by folate-receptor-mediated endocytosis. dsRNA compounds bearing folic acid would be efficiently transported into the cell via the folate-receptor-mediated endocytosis. Li and coworkers report that attachment of folic acid to the 3'-terminus of an oligonucleotide resulted in an 8-fold increase in cellular uptake of the oligonucleotide. Li, S.; Deshmukh, H. M.; Huang, L. *Pharm. Res.* 1998, 15, 1540. Other ligands that have been conjugated to oligonucleotides include polyethylene glycols, carbohydrate clusters, cross-linking agents, porphyrin conjugates, delivery peptides and lipids such as cholesterol and cholesterylamine. Examples of carbohydrate clusters include Chol-p-(GalNAc)$_3$ (N-acetyl galactosamine cholesterol) and LCO(GalNAc)$_3$ (N-acetyl galactosamine-3'-Lithocholic-oleoyl.

In certain instances, conjugation of a cationic ligand to oligonucleotides results in improved resistance to nucleases. Representative examples of cationic ligands are propylammonium and dimethylpropylammonium. Interestingly, antisense oligonucleotides were reported to retain their high binding affinity to mRNA when the cationic ligand was dispersed throughout the oligonucleotide. See M. Manoharan *Antisense & Nucleic Acid Drug Development* 2002, 12, 103 and references therein.

In some cases, a ligand can be multifunctional and/or a dsRNA can be conjugated to more than one ligand. For example, the dsRNA can be conjugated to one ligand for improved uptake and to a second ligand for improved release.

The ligand-conjugated dsRNA of the invention may be synthesized by the use of a dsRNA that bears a pendant reactive functionality, such as that derived from the attachment of a linking molecule onto the dsRNA. This reactive oligonucleotide may be reacted directly with commercially-available ligands, ligands that are synthesized bearing any of a variety of protecting groups, or ligands that have a linking moiety attached thereto. The methods of the invention facilitate the synthesis of ligand-conjugated dsRNA by the use of, in some embodiments, nucleoside monomers that have been appropriately conjugated with ligands and that may further be attached to a solid-support material. Such ligand-nucleoside conjugates, optionally attached to a solid-support material, are prepared according to certain embodiments of the methods described herein via reaction of a selected serum-binding ligand with a linking moiety located on the 5' position of a nucleoside or oligonucleotide. In certain instances, a dsRNA bearing an aralkyl ligand attached to the 3'-terminus of the dsRNA is prepared by first covalently attaching a monomer building block to a controlled-pore-glass support via a long-chain aminoalkyl group. Then, nucleotides are bonded via standard solid-phase synthesis techniques to the monomer building-block bound to the solid support. The monomer building block may be a nucleoside or other organic compound that is compatible with solid-phase synthesis.

The dsRNA used in the conjugates of the invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

Synthesis

Teachings regarding the synthesis of particular modified oligonucleotides may be found in the following U.S. Pat. Nos. 5,138,045 and 5,218,105, drawn to polyamine conjugated oligonucleotides; U.S. Pat. No. 5,212,295, drawn to monomers for the preparation of oligonucleotides having chiral phosphorus linkages; U.S. Pat. Nos. 5,378,825 and 5,541,307, drawn to oligonucleotides having modified backbones; U.S. Pat. No. 5,386,023, drawn to backbone-modified oligonucleotides and the preparation thereof through reductive coupling; U.S. Pat. No. 5,457,191, drawn to modified nucleobases based on the 3-deazapurine ring system and methods of synthesis thereof; U.S. Pat. No. 5,459,255, drawn to modified nucleobases based on N-2 substituted purines; U.S. Pat. No. 5,521,302, drawn to processes for preparing oligonucleotides having chiral phosphorus linkages; U.S. Pat. No. 5,539,082, drawn to peptide nucleic acids; U.S. Pat. No. 5,554,746, drawn to oligonucleotides having β-lactam backbones; U.S. Pat. No. 5,571,902, drawn to methods and materials for the synthesis of oligonucleotides; U.S. Pat. No. 5,578,718, drawn to nucleosides having alkylthio groups, wherein such groups may be used as linkers to other moieties attached at any of a variety of positions of the nucleoside; U.S. Pat. Nos. 5,587,361 and 5,599,797, drawn to oligonucleotides having phosphorothioate linkages of high chiral purity; U.S. Pat. No. 5,506,351, drawn to processes for the preparation of 2'-O-alkyl guanosine and related compounds, including 2,6-diaminopurine compounds; U.S. Pat. No. 5,587,469, drawn to oligonucleotides having N-2 substituted purines; U.S. Pat. No. 5,587,470, drawn to oligonucleotides having 3-deazapurines; U.S. Pat. No. 5,223,168, and U.S. Pat. No. 5,608,046, both drawn to conjugated 4'-desmethyl nucleoside analogs; U.S. Pat. Nos. 5,602,240, and 5,610,289, drawn to backbone-modified oligonucleotide analogs; U.S. Pat. Nos. 6,262,241, and 5,459,255, drawn to, inter alia, methods of synthesizing 2'-fluoro-oligonucleotides.

In the ligand-conjugated dsRNA and ligand-molecule bearing sequence-specific linked nucleosides of the invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. Oligonucleotide conjugates bearing a variety of molecules such as steroids, vitamins, lipids and reporter molecules, has previously been described (see Manoharan et al., PCT Application WO 93/07883). In one embodiment, the oligonucleotides or linked nucleosides featured in the invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

The incorporation of a 2'-O-methyl, 2'-O-ethyl, 2'-O-propyl, 2'-O-allyl, 2'-O-aminoalkyl or 2'-deoxy-2'-fluoro group in nucleosides of an oligonucleotide confers enhanced hybridization properties to the oligonucleotide. Further, oligonucleotides containing phosphorothioate backbones have enhanced nuclease stability. Thus, functionalized, linked nucleosides of the invention can be augmented to include either or both a phosphorothioate backbone or a 2'-O-methyl, 2'-O-ethyl, 2'-O-propyl, 2'-O-aminoalkyl, 2'-O-allyl or 2'-deoxy-2'-fluoro group. A summary listing of some of the oligonucleotide modifications known in the art is found at, for example, PCT Publication WO 200370918.

In some embodiments, functionalized nucleoside sequences of the invention possessing an amino group at the 5'-terminus are prepared using a DNA synthesizer, and then reacted with an active ester derivative of a selected ligand. Active ester derivatives are well known to those skilled in the art. Representative active esters include N-hydrosuccinimide esters, tetrafluorophenolic esters, pentafluorophenolic esters and pentachlorophenolic esters. The reaction of the amino group and the active ester produces an oligonucleotide in which the selected ligand is attached to the 5'-position through a linking group. The amino group at the 5'-terminus can be prepared utilizing a 5'-Amino-Modifier C6 reagent. In one embodiment, ligand molecules may be conjugated to oligonucleotides at the 5'-position by the use of a ligand-nucleoside phosphoramidite wherein the ligand is linked to the 5'-hydroxy group directly or indirectly via a linker. Such ligand-nucleoside phosphoramidites are typically used at the end of an automated synthesis procedure to provide a ligand-conjugated oligonucleotide bearing the ligand at the 5'-terminus.

Examples of modified internucleoside linkages or backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free-acid forms are also included.

Representative United States patents relating to the preparation of the above phosphorus-atom-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; 5,625,050; and 5,697,248, each of which is herein incorporated by reference.

Examples of modified internucleoside linkages or backbones that do not include a phosphorus atom therein (i.e., oligonucleosides) have backbones that are formed by short chain alkyl or cycloalkyl intersugar linkages, mixed heteroatom and alkyl or cycloalkyl intersugar linkages, or one or more short chain heteroatomic or heterocyclic intersugar linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative United States patents relating to the preparation of the above oligonucleosides include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

In certain instances, the oligonucleotide may be modified by a non-ligand group. A number of non-ligand molecules have been conjugated to oligonucleotides in order to enhance the activity, cellular distribution or cellular uptake of the oligonucleotide, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such oligonucleotide conjugates have been listed above. Typical conjugation protocols involve the synthesis of oligonucleotides bearing an aminolinker at one or more positions of the sequence. The amino group is then reacted with the molecule being conjugated using appropriate coupling or activating reagents. The conjugation reaction may be performed either with the oligonucleotide still bound to the solid support or following cleavage of the oligonucleotide in solution phase. Purification of the oligonucleotide conjugate by HPLC typically affords the pure conjugate. The use of a cholesterol conjugate is particularly preferred since such a moiety can increase targeting liver cells, a site of PCSK9 expression.

Vector Encoded RNAi Agents

In another aspect of the invention, PCSK9 specific dsRNA molecules that modulate PCSK9 gene expression activity are expressed from transcription units inserted into DNA or RNA vectors (see, e.g., Couture, A, et al., *TIG*. (1996), 12:5-10; Skillern, A., et al., International PCT Publication No. WO 00/22113, Conrad, International PCT Publication No. WO 00/22114, and Conrad, U.S. Pat. No. 6,054,299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., *Proc. Natl. Acad. Sci. USA* (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In one embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., *Curr. Topics Micro. Immunol.* (1992) 158:97-129)); adenovirus (see, for example, Berkner, et al., BioTechniques (1998) 6:616), Rosenfeld et al. (1991, *Science* 252:431-434), and Rosenfeld et al. (1992), *Cell* 68:143-155)); or alphavirus as well as others known in the art. Retroviruses have been used to introduce a variety of genes into many different cell types, including epithelial cells, in vitro and/or in vivo (see, e.g., Eglitis, et al., *Science* (1985) 230:1395-1398; Danos and Mulligan, *Proc. Natl. Acad. Sci. USA* (1998) 85:6460-6464; Wilson et al., 1988, *Proc. Natl. Acad. Sci. USA* 85:3014-3018; Armentano et al., 1990, *Proc. Natl. Acad. Sci. USA* 87:61416145; Huber et al., 1991, *Proc. Natl. Acad. Sci. USA* 88:8039-8043; Ferry et al., 1991, *Proc. Natl. Acad. Sci. USA* 88:8377-8381; Chowdhury et al., 1991, *Science* 254:1802-1805; van Beusechem. et al., 1992, *Proc. Nad. Acad. Sci. USA* 89:7640-19; Kay et al., 1992, *Human Gene Therapy* 3:641-647; Dai et al., 1992, *Proc. Natl. Acad. Sci. USA* 89:10892-

10895; Hwu et al., 1993, *J. Immunol.* 150:4104-4115; U.S. Pat. No. 4,868,116; U.S. Pat. No. 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, *Human Gene Therapy* 2:5-10; Cone et al., 1984, *Proc. Natl. Acad. Sci. USA* 81:6349). Recombinant adenoviral vectors can be used to infect a wide variety of cells and tissues in susceptible hosts (e.g., rat, hamster, dog, and chimpanzee) (Hsu et al., 1992, *J. Infectious Disease,* 166:769), and also have the advantage of not requiring mitotically active cells for infection.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), *J Virol* 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), *Gene Therap.* 2: 301-310; Eglitis M A (1988), *Biotechniques* 6: 608-614; Miller A D (1990), *Hum Gene Therap.* 1: 5-14; Anderson W F (1998), *Nature* 392: 25-30; and Rubinson D A et al., *Nat. Genet.* 33: 401-406, the entire disclosures of which are herein incorporated by reference.

Preferred viral vectors are those derived from AV and AAV. In a particularly preferred embodiment, the dsRNA of the invention is expressed as two separate, complementary single-stranded RNA molecules from a recombinant AAV vector having, for example, either the U6 or H1 RNA promoters, or the cytomegalovirus (CMV) promoter.

A suitable AV vector for expressing the dsRNA of the invention, a method for constructing the recombinant AV vector, and a method for delivering the vector into target cells, are described in Xia H et al. (2002), Nat. Biotech. 20: 1006-1010.

Suitable AAV vectors for expressing the dsRNA of the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

The promoter driving dsRNA expression in either a DNA plasmid or viral vector of the invention may be a eukaryotic RNA polymerase I (e.g. ribosomal RNA promoter), RNA polymerase II (e.g. CMV early promoter or actin promoter or U1 snRNA promoter) or generally RNA polymerase III promoter (e.g. U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g., the insulin regulatory sequence for pancreas (Bucchini et al., 1986, Proc. Natl. Acad. Sci. USA 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g. Oligofectamine) or non-cationic lipid-based carriers (e.g. Transit-TKO™). Multiple lipid transfections for dsRNA-mediated knockdowns targeting different regions of a single PCSK9 gene or multiple PCSK9 genes over a period of a week or more are also contemplated by the invention. Successful introduction of the vectors of the invention into host cells can be monitored using various known methods. For example, transient transfection. can be signaled with a reporter, such as a fluorescent marker, such as Green Fluorescent Protein (GFP). Stable transfection of ex vivo cells can be ensured using markers that provide the transfected cell with resistance to specific environmental factors (e.g., antibiotics and drugs), such as hygromycin B resistance.

The PCSK9 specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Pharmaceutical Compositions Containing dsRNA

In one embodiment, the invention provides pharmaceutical compositions containing a dsRNA, as described herein, and a pharmaceutically acceptable carrier and methods of administering the same. The pharmaceutical composition containing the dsRNA is useful for treating a disease or disorder associated with the expression or activity of a PCSK9 gene, such as pathological processes mediated by PCSK9 expression, e.g., hyperlipidemia. Such pharmaceutical compositions are formulated based on the mode of delivery.

Dosage

The pharmaceutical compositions featured herein are administered in dosages sufficient to inhibit expression of PCSK9 genes. In general, a suitable dose of dsRNA will be in the range of 0.01 to 200.0 milligrams per kilogram body weight of the recipient per day, generally in the range of 1 to 50 mg per kilogram body weight per day. For example, the dsRNA can be administered at 0.01 mg/kg, 0.05 mg/kg, 0.5 mg/kg, 1 mg/kg, 1.5 mg/kg, 2.0 mg/kg, 3.0 mg/kg, 5.0 mg/kg, 10 mg/kg, 20 mg/kg, 30 mg/kg, 40 mg/kg, or 50 mg/kg per single dose.

In another embodiment, the dosage is between 0.01 and 0.2 mg/kg. For example, the dsRNA can be administered at a dose of 0.01 mg/kg, 0.02 mg/kg, 0.03 mg/kg, 0.04 mg/kg, 0.05 mg/kg, 0.06 mg/kg, 0.07 mg/kg 0.08 mg/kg 0.09 mg/kg, 0.10 mg/kg, 0.11 mg/kg, 0.12 mg/kg, 0.13 mg/kg, 0.14 mg/kg, 0.15 mg/kg, 0.16 mg/kg, 0.17 mg/kg, 0.18 mg/kg, 0.19 mg/kg, or 0.20 mg/kg.

In one embodiment, the dosage is between 0.2 mg/kg and 1.5 mg/kg. For example, the dsRNA can be administered at a dose of 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1 mg/kg, 1.1 mg/kg, 1.2 mg/kg, 1.3 mg/kg, 1.4 mg/kg, or 1.5 mg/kg.

The dsRNA can be administered at a dose of 0.03, 0.1, 0.3, or 1.3, or 3.0 mg/kg.

The pharmaceutical composition can be administered once daily, or the dsRNA may be administered as two, three, or more sub-doses at appropriate intervals throughout the day. The effect of a single dose on PCSK9 levels is long lasting, such that subsequent doses are administered at not more than 7 day intervals, or at not more than 1, 2, 3, or 4 week intervals.

In one embodiment the lipid formulated PCSK9 targeted dsRNA is administered at a first dose of about 3 mg/kg followed by administering at least one subsequent dose once a week, wherein the subsequent dose is lower than the first dose, e.g., the subsequent dose is about 1.0 mg/kg or about 0.3 mg/kg. The subsequent dose can be administered, e.g., once a week for four weeks.

In some embodiments the dsRNA is administered using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by PCSK9 expression. Such models are used for in vivo testing of dsRNA, as well as for determining a therapeutically effective dose. A suitable mouse model is, for example, a mouse containing a plasmid expressing human PCSK9. Another suitable mouse model is a transgenic mouse carrying a transgene that expresses human PCSK9.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dsRNAs featured in the invention can be administered in combination with other known agents effective in treatment of pathological processes mediated by target gene expression. In any event, the administering physician can adjust the amount and timing of dsRNA administration on the basis of results observed using standard measures of efficacy known in the art or described herein.

Administration

The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal, and subdermal, oral or parenteral, e.g., subcutaneous.

Typically, when treating a mammal with hyperlipidemia, the dsRNA molecules are administered systemically via parental means. Parenteral administration includes intravenous, intra-arterial, subcutaneous, intraperitoneal or intramuscular injection or infusion; or intracranial, e.g., intraparenchymal, intrathecal or intraventricular, administration. For example, dsRNAs, conjugated or unconjugate or formulated with or without liposomes, can be administered intravenously to a patient. For such, a dsRNA molecule can be formulated into compositions such as sterile and non-sterile aqueous solutions, non-aqueous solutions in common solvents such as alcohols, or solutions in liquid or solid oil bases. Such solutions also can contain buffers, diluents, and other suitable additives. For parenteral, intrathecal, or intraventricular administration, a dsRNA molecule can be formulated into compositions such as sterile aqueous solutions, which also can contain buffers, diluents, and other suitable additives (e.g., penetration enhancers, carrier compounds, and other pharmaceutically acceptable carriers). Formulations are described in more detail herein.

The dsRNA can be delivered in a manner to target a particular tissue, such as the liver (e.g., the hepatocytes of the liver).

Formulations

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. In one aspect are formulations that target the liver when treating hepatic disorders such as hyperlipidemia.

In addition, dsRNA that target the PCSK9 gene can be formulated into compositions containing the dsRNA admixed, encapsulated, conjugated, or otherwise associated with other molecules, molecular structures, or mixtures of nucleic acids. For example, a composition containing one or more dsRNA agents that target the PCSK9 gene can contain other therapeutic agents, such as other cancer therapeutics or one or more dsRNA compounds that target non-PCSK9 genes.

Oral, Parenteral, Topical, and Biologic Formulations

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. dsRNAs featured in the invention may be delivered orally, in granular form including sprayed dried particles, or complexed to form micro or nanoparticles. dsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, U.S. Patent Publication. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Suitable topical formulations include those in which the dsRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). dsRNAs featured in the invention may be encapsulated within liposomes or may form complexes thereto, in particular to cationic liposomes. Alternatively, dsRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference. In addition, dsRNA molecules can be administered to a mammal as biologic or abiologic means as described in, for example, U.S. Pat. No. 6,271,359. Abiologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic and neutral lipids commonly used to transfect cells in vitro. Cationic lipids can complex (e.g., charge-associate) with negatively charged nucleic acids to form liposomes. Examples of cationic liposomes include, without limitation, lipofectin, lipofectamine, lipofectace, and DOTAP. Procedures for forming liposomes are well known in the art. Liposome compositions can be formed, for example, from phosphatidylcholine, dimyristoyl phosphatidylcholine, dipalmitoyl phosphatidylcholine, dimyristoyl phosphatidylglycerol, or dioleoyl phosphatidylethanolamine. Numerous lipophilic agents are commercially available, including Lipofectin™ (Invitrogen/Life Technologies, Carlsbad, Calif.) and Effectene™ (Qiagen, Valencia, Calif.). In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al. (Nature Biotechnology, 15: 647-652 (1997)) can be used. In other embodiments, polycations such as polyethyleneimine can be used to achieve delivery in vivo and ex vivo (Boletta et al., J. Am Soc. Nephrol. 7: 1728 (1996)). Additional information regarding the use of liposomes to deliver nucleic acids can be found in U.S. Pat. No. 6,271,359, PCT Publication WO 96/40964 and Morrissey, D. et al. 2005. Nat Biotechnol. 23(8):1002-7.

Biologic delivery can be accomplished by a variety of methods including, without limitation, the use of viral vectors. For example, viral vectors (e.g., adenovirus and herpes virus vectors) can be used to deliver dsRNA molecules to liver cells. Standard molecular biology techniques can be used to introduce one or more of the dsRNAs provided herein into one of the many different viral vectors previously developed to deliver nucleic acid to cells. These resulting viral vectors can be used to deliver the one or more dsRNAs to cells by, for example, infection.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include: liposomes obtained from natural phospholipids are biocompatible and biodegradable; liposomes can incorporate a wide range of water and lipid soluble drugs; and liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/po-lyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al., S.T.P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al.).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes, it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, a dsRNA featured in the invention is fully encapsulated in the lipid formulation, e.g., to form a nucleic acid-lipid particle, e.g. Nucleic acid-lipid particles typically contain a cationic lipid, a non-cationic lipid, a sterol, and a lipid that prevents aggregation of the particle (e.g., a PEG-lipid conjugate). Nucleic acid-lipid particles are extremely useful for systemic applications, as they exhibit extended circulation lifetimes following intravenous (i.v.) injection and accumulate at distal sites (e.g., sites physically separated from the administration site). In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

Nucleic acid-lipid particles can further include one or more additional lipids and/or other components such as cholesterol. Other lipids may be included in the liposome compositions for a variety of purposes, such as to prevent lipid oxidation or to attach ligands onto the liposome surface. Any of a number of lipids may be present, including amphipathic, neutral, cationic, and anionic lipids. Such lipids can be used alone or in combination. Specific examples of additional lipid components that may be present are described herein.

Additional components that may be present in a nucleic acid-lipid particle include bilayer stabilizing components such as polyamide oligomers (see, e.g., U.S. Pat. No. 6,320,017), peptides, proteins, detergents, lipid-derivatives, such as PEG coupled to phosphatidylethanolamine and PEG conjugated to ceramides (see, U.S. Pat. No. 5,885,613).

A nucleic acid-lipid particle can include one or more of a second amino lipid or cationic lipid, a neutral lipid, a sterol, and a lipid selected to reduce aggregation of lipid particles during formation, which may result from steric stabilization of particles which prevents charge-induced aggregation during formation.

Nucleic acid-lipid particles include, e.g., a SPLP, pSPLP, and SNALP. The term "SNALP" refers to a stable nucleic acid-lipid particle, including SPLP. The term "SPLP" refers to a nucleic acid-lipid particle comprising plasmid DNA encapsulated within a lipid vesicle. SPLPs include "pSPLP," which include an encapsulated condensing agent-nucleic acid complex as set forth in PCT Publication No. WO 00/03683.

The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1, 7:1, 8:1, 9:1, 10:1, 11:1, 12:1, or 33:1.

Cationic Lipids

The nucleic acid-lipid particles of the invention typically include a cationic lipid. The cationic lipid may be, for example, N,N-dioleyl-N,N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALNY-100), (6Z,9Z,28Z,31Z)-heptatriaconta-6,9,28,31-tetraen-19-yl 4-(dimethylamino)butanoate (MC3), or a mixture thereof.

Other cationic lipids, which carry a net positive charge at about physiological pH, in addition to those specifically described above, may also be included in lipid particles of the invention. Such cationic lipids include, but are not limited to, N,N-dioleyl-N,N-dimethylammonium chloride ("DODAC"); N-(2,3-dioleyloxy)propyl-N,N-N-triethylammonium chloride ("DOTMA"); N,N-distearyl-N,N-dimethylammonium bromide ("DDAB"); N-(2,3-dioleoyloxy) propyl)-N,N,N-trimethylammonium chloride ("DOTAP");

1,2-Dioleyloxy-3-trimethylaminopropane chloride salt ("DOTAP.Cl"); 3β-(N-(N',N'-dimethylaminoethane)-carbamoyl)cholesterol ("DC-Chol"), N-(1-(2,3-dioleyloxy)propyl)-N-2-(sperminecarboxamido)ethyl)-N,N-dimethylammonium trifluoracetate ("DOSPA"), dioctadecylamidoglycyl carboxyspermine ("DOGS"), 1,2-dileoyl-sn-3-phosphoethanolamine ("DOPE"), 1,2-dioleoyl-3-dimethylammonium propane ("DODAP"), N,N-dimethyl-2,3-dioleyloxy)propylamine ("DODMA"), and N-(1,2-dimyristyloxyprop-3-yl)-N,N-dimethyl-N-hydroxyethyl ammonium bromide ("DMRIE"). Additionally, a number of commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL). In particular embodiments, a cationic lipid is an amino lipid.

As used herein, the term "amino lipid" is meant to include those lipids having one or two fatty acid or fatty alkyl chains and an amino head group (including an alkylamino or dialkylamino group) that may be protonated to form a cationic lipid at physiological pH.

Other amino lipids would include those having alternative fatty acid groups and other dialkylamino groups, including those in which the alkyl substituents are different (e.g., N-ethyl-N-methylamino-, N-propyl-N-ethylamino- and the like). For those embodiments in which $R^{11}$ and $R^{12}$ are both long chain alkyl or acyl groups, they can be the same or different. In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of $C_{14}$ to $C_{22}$ are preferred. Other scaffolds can also be used to separate the amino group and the fatty acid or fatty alkyl portion of the amino lipid. Suitable scaffolds are known to those of skill in the art.

In certain embodiments, amino or cationic lipids of the invention have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwiterrionic, are not excluded from use in the invention.

In certain embodiments, protonatable lipids according to the invention have a pKa of the protonatable group in the range of about 4 to about 11. Most preferred is pKa of about 4 to about 7, because these lipids will be cationic at a lower pH formulation stage, while particles will be largely (though not completely) surface neutralized at physiological pH around pH 7.4. One of the benefits of this pKa is that at least some nucleic acid associated with the outside surface of the particle will lose its electrostatic interaction at physiological pH and be removed by simple dialysis; thus greatly reducing the particle's susceptibility to clearance.

One example of a cationic lipid is 1,2-Dilinolenyloxy-N,N-dimethylaminopropane (DLinDMA). Synthesis and preparation of nucleic acid-lipid particles including DLinDMA is described in International application number PCT/CA2009/0496, filed Apr. 15, 2009.

In one embodiment, the cationic lipid XTC (2,2-Dilinoleyl-4-dimethylaminoethyl-[1,3]-dioxolane) is used to prepare nucleic acid-lipid particles. Synthesis of XTC is described in U.S. provisional patent application No. 61/107,998 filed on Oct. 23, 2008, which is herein incorporated by reference.

In one aspect, the cationic lipids have the structure

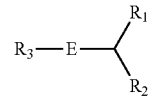

and salts or isomers thereof, wherein $R_1$ and $R_2$ are each independently for each occurrence optionally substituted $C_{10}$-$C_{30}$ alkyl, optionally substituted $C_{10}$-$C_{30}$ alkenyl, optionally substituted $C_{10}$-$C_{30}$ alkynyl, optionally substituted $C_{10}$-$C_{30}$ acyl, or -linker-ligand; $R_3$ is H, optionally substituted $C_1$-$C_{10}$ alkyl, optionally substituted $C_2$-$C_{10}$ alkenyl, optionally substituted $C_2$-$C_{10}$ alkynyl, alkylhetrocycle, alkylphosphate, alkylphosphorothioate, alkylphosphorodithioate, alkylphosphonates, alkylamines, hydroxyalkyls, Ω-aminoalkyls, Ω-(substituted)aminoalkyls, Ω-phosphoalkyls, Ω-thiophosphoalkyls, optionally substituted polyethylene glycol (PEG, mw 100-40K), optionally substituted mPEG (mw 120-40K), heteroaryl, heterocycle, or linker-ligand; and E is C(O)O or OC(O). Synthesis and use of this lipid family is described in WO 2010/054401 (PCTUS2009/063927 filed on Nov. 10, 2009. The cationic lipid MC3 is one embodiment of this family of cationic lipids.

In another embodiment, the cationic lipid MC3 ((6Z,9Z,28Z,31Z)-heptatriaconta-6,9,28,31-tetraen-19-yl4-(dimethylamino)butanoate), (e.g., DLin-M-C3-DMA) is used to prepare nucleic acid-lipid particles. Synthesis of MC3 and MC3 comprising formulations are described, e.g., in U.S. Provisional Ser. No. 61/244,834, filed Sep. 22, 2009, and U.S. Provisional Ser. No. 61/185,800, filed Jun. 10, 2009, and U.S. patent application Ser. No. 12/813/448 filed on Jun. 10, 2010, which are hereby incorporated by reference.

In another embodiment, the cationic lipid ALNY-100 ((3aR,5s,6aS)-N,N-dimethyl-2,2-di((9Z,12Z)-octadeca-9,12-dienyl)tetrahydro-3aH-cyclopenta[d][1,3]dioxol-5-amine) is used to prepare nucleic acid-lipid particles. Synthesis of ALNY-100 is described in International patent application number PCT/US09/63933 filed on Nov. 10, 2009, which is herein incorporated by reference.

Figure 28:
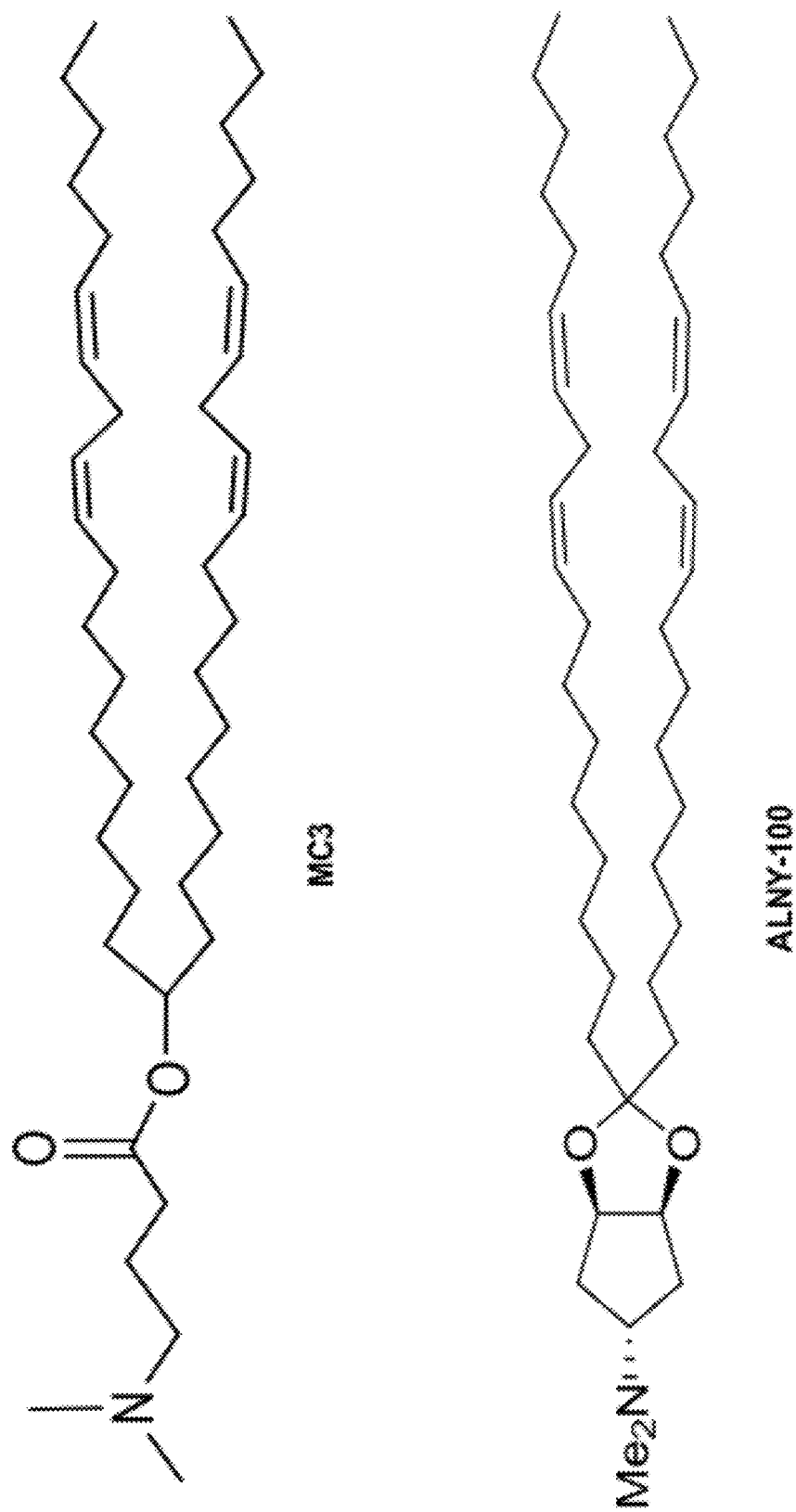
FIG. 28 illustrates the chemical structures of the cationic lipids MC3 and ALNY-100.

FIG. 28 illustrates the structures of ALNY-100 and MC3.

The cationic lipid may comprise from about 20 mol % to about 70 mol % or about 45-65 mol % or about 10, 20, 30, 40, 50, 60, or 70 mol % of the total lipid present in the particle.

Non-Cationic Lipids

The nucleic acid-lipid particles of the invention can include a non-cationic lipid. The non-cationic lipid may be an anionic lipid or a neutral lipid. Examples include but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof.

Anionic lipids suitable for use in lipid particles of the invention include, but are not limited to, phosphatidylglycerol, cardiolipin, diacylphosphatidylserine, diacylphosphatidic acid, N-dodecanoyl phosphatidylethanoloamine, N-succinyl phosphatidylethanolamine, N-glutaryl phosphatidylethanolamine, lysylphosphatidylglycerol, and other anionic modifying groups joined to neutral lipids.

Neutral lipids, when present in the lipid particle, can be any of a number of lipid species which exist either in an uncharged or neutral zwitterionic form at physiological pH. Such lipids include, for example diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., liposome size and stability of the liposomes in the bloodstream. Preferably, the neutral lipid component is a lipid having two acyl groups, (i.e., diacylphosphatidylcholine and diacylphosphatidylethanolamine). Lipids having a variety of acyl chain groups of varying chain length and degree of saturation are available or may be isolated or synthesized by well-known techniques. In one group of embodiments, lipids containing saturated fatty acids with carbon chain lengths in the range of $C_{14}$ to $C_{22}$ are preferred. In another group of embodiments, lipids with mono- or di-unsaturated fatty acids with carbon chain lengths in the range of $C_{14}$ to $C_{22}$ are used. Additionally, lipids having mixtures of saturated and unsaturated fatty acid chains can be used. Preferably, the neutral lipids used in the invention are DOPE, DSPC, POPC, or any related phosphatidylcholine. The neutral lipids useful in the invention may also be composed of sphingomyelin, dihydrosphingomyeline, or phospholipids with other head groups, such as serine and inositol.

In one embodiment the non-cationic lipid is distearoylphosphatidylcholine (DSPC). In another embodiment the non-cationic lipid is dipalmitoylphosphatidylcholine (DPPC).

The non-cationic lipid may be from about 5 mol % to about 90 mol %, about 5 mol % to about 10 mol %, about 10 mol %, or about 58 mol % if cholesterol is included, of the total lipid present in the particle.

Conjugated Lipids

Conjugated lipids can be used in nucleic acid-lipid particle to prevent aggregation, including polyethylene glycol (PEG)-modified lipids, monosialoganglioside Gm1, and polyamide oligomers ("PAO") such as (described in U.S. Pat. No. 6,320,017). Other compounds with uncharged, hydrophilic, steric-barrier moieties, which prevent aggregation during formulation, like PEG, Gm1 or ATTA, can also be coupled to lipids for use as in the methods and compositions of the invention. ATTA-lipids are described, e.g., in U.S. Pat. No. 6,320,017, and PEG-lipid conjugates are described, e.g., in U.S. Pat. Nos. 5,820,873, 5,534,499 and 5,885,613. Typically, the concentration of the lipid component selected to reduce aggregation is about 1 to 15% (by mole percent of lipids).

Specific examples of PEG-modified lipids (or lipid-polyoxyethylene conjugates) that are useful in the invention can have a variety of "anchoring" lipid portions to secure the PEG portion to the surface of the lipid vesicle. Examples of suitable PEG-modified lipids include PEG-modified phosphatidylethanolamine and phosphatidic acid, PEG-ceramide conjugates (e.g., PEG-CerC14 or PEG-CerC20) which are described in co-pending U.S. Ser. No. 08/486,214, incorporated herein by reference, PEG-modified dialkylamines and PEG-modified 1,2-diacyloxypropan-3-amines. Particularly preferred are PEG-modified diacylglycerols and dialkylglycerols.

In embodiments where a sterically-large moiety such as PEG or ATTA are conjugated to a lipid anchor, the selection of the lipid anchor depends on what type of association the conjugate is to have with the lipid particle. It is well known that mePEG (mw2000)-diastearoylphosphatidylethanolamine (PEG-DSPE) will remain associated with a liposome until the particle is cleared from the circulation, possibly a matter of days. Other conjugates, such as PEG-CerC20 have similar staying capacity. PEG-CerC14, however, rapidly exchanges out of the formulation upon exposure to serum, with a $T_{1/2}$ less than 60 minutes in some assays. As illustrated in U.S. patent application Ser. No. 08/486,214, at least three characteristics influence the rate of exchange: length of acyl chain, saturation of acyl chain, and size of the steric-barrier head group. Compounds having suitable variations of these features may be useful for the invention. For some therapeutic applications, it may be preferable for the PEG-modified lipid to be rapidly lost from the nucleic acid-lipid particle in vivo and hence the PEG-modified lipid will possess relatively short lipid anchors. In other therapeutic applications, it may be preferable for the nucleic acid-lipid particle to exhibit a longer plasma circulation lifetime and hence the PEG-modified lipid will possess relatively longer lipid anchors. Exemplary lipid anchors include those having lengths of from about $C_{14}$ to about $C_{22}$, preferably from about $C_{14}$ to about $C_{16}$. In some embodiments, a PEG moiety, for example an mPEG-$NH_2$, has a size of about 1000, 2000, 5000, 10,000, 15,000 or 20,000 Daltons.

It should be noted that aggregation preventing compounds do not necessarily require lipid conjugation to function properly. Free PEG or free ATTA in solution may be sufficient to prevent aggregation. If the particles are stable after formulation, the PEG or ATTA can be dialyzed away before administration to a subject.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). Additional conjugated lipids include polyethylene glycol-didimyristoyl glycerol (C14-PEG or PEG-C14, where PEG has an average molecular weight of 2000 Da) (PEG-DMG); (R)-2,3-bis(octadecyloxy)propyl]-(methoxy poly(ethylene glycol)2000) propylcarbamate) (PEG-DSG); PEG-carbamoyl-1,2-dimyristyloxypropylamine, in which PEG has an average molecular weight of 2000 Da (PEG-cDMA); N-Acetylgalactosamine-((R)-2,3-bis(octadecyloxy)propyl1-(methoxy poly(ethylene glycol)2000)propylcarbamate)) (GalNAc-PEG-DSG); and polyethylene glycol-dipalmitoylglycerol (PEG-DPG).

In one embodiment the conjugated lipid is PEG-DMG. In another embodiment the conjugated lipid is PEG-cDMA. In still another embodiment the conjugated lipid is PEG-DPG. Alternatively the conjugated lipid is GalNAc-PEG-DSG.

The conjugated lipid that prevents aggregation of particles may be from 0 mol % to about 20 mol % or about 0.5 to about 5.0 mol % or about 2 mol % of the total lipid present in the particle.

The sterol component of the lipid mixture, when present, can be any of those sterols conventionally used in the field of liposome, lipid vesicle or lipid particle preparation. A preferred sterol is cholesterol.

In some embodiments, the nucleic acid-lipid particle further includes a sterol, e.g., a cholesterol at, e.g., about 10 mol % to about 60 mol % or about 25 to about 40 mol % or about 48 mol % of the total lipid present in the particle.

Lipoproteins

In one embodiment, the formulations of the invention further comprise an apolipoprotein. As used herein, the term "apolipoprotein" or "lipoprotein" refers to apolipoproteins known to those of skill in the art and variants and fragments thereof and to apolipoprotein agonists, analogues or fragments thereof described below.

Suitable apolipoproteins include, but are not limited to, ApoA-I, ApoA-II, ApoA-IV, ApoA-V and ApoE, and active polymorphic forms, isoforms, variants and mutants as well as fragments or truncated forms thereof. In certain embodiments, the apolipoprotein is a thiol containing apolipoprotein. "Thiol containing apolipoprotein" refers to an apolipoprotein, variant, fragment or isoform that contains at least one cysteine residue. The most common thiol containing apolipoproteins are ApoA-I Milano (ApoA-$I_M$) and ApoA-I Paris (ApoA-$I_P$) which contain one cysteine residue (Jia et al., 2002, Biochem. Biophys. Res. Comm. 297: 206-13; Bielicki and Oda, 2002, Biochemistry 41: 2089-96). ApoA-II, ApoE2 and ApoE3 are also thiol containing apolipoproteins. Isolated ApoE and/or active fragments and polypeptide analogues thereof, including recombinantly produced forms thereof, are described in U.S. Pat. Nos. 5,672,685; 5,525,472; 5,473,039; 5,182,364; 5,177,189; 5,168,045; 5,116,739; the disclosures of which are herein incorporated by reference. ApoE3 is disclosed in Weisgraber, et al., "Human E apoprotein heterogeneity: cysteine-arginine interchanges in the amino acid sequence of the apo-E isoforms," J. Biol. Chem. (1981) 256: 9077-9083; and Rall, et al., "Structural basis for receptor binding heterogeneity of apolipoprotein E from type III hyperlipoproteinemic subjects," Proc. Nat. Acad. Sci. (1982) 79: 4696-4700. (See also GenBank accession number K00396.)

In certain embodiments, the apolipoprotein can be in its mature form, in its preproapolipoprotein form or in its proapolipoprotein form. Homo- and heterodimers (where feasible) of pro- and mature ApoA-I (Duverger et al., 1996, Arterioscler. Thromb. Vasc. Biol. 16(12):1424-29), ApoA-I Milano (Klon et al., 2000, Biophys. J. 79:(3)1679-87; Franceschini et al., 1985, J. Biol. Chem. 260: 1632-35), ApoA-I Paris (Daum et al., 1999, J. Mol. Med. 77:614-22), ApoA-II (Shelness et al., 1985, J. Biol. Chem. 260(14):8637-46; Shelness et al., 1984, J. Biol. Chem. 259(15):9929-35), ApoA-IV (Duverger et al., 1991, Euro. J. Biochem. 201(2):373-83), and ApoE (McLean et al., 1983, J. Biol. Chem. 258(14):8993-9000) can also be utilized within the scope of the invention.

In certain embodiments, the apolipoprotein can be a fragment, variant or isoform of the apolipoprotein. The term "fragment" refers to any apolipoprotein having an amino acid sequence shorter than that of a native apolipoprotein and which fragment retains the activity of native apolipoprotein, including lipid binding properties. By "variant" is meant substitutions or alterations in the amino acid sequences of the apolipoprotein, which substitutions or alterations, e.g., additions and deletions of amino acid residues, do not abolish the activity of native apolipoprotein, including lipid binding properties. Thus, a variant can comprise a protein or peptide having a substantially identical amino acid sequence to a native apolipoprotein provided herein in which one or more amino acid residues have been conservatively substituted with chemically similar amino acids. Examples of conservative substitutions include the substitution of at least one hydrophobic residue such as isoleucine, valine, leucine or methionine for another. Likewise, the present invention contemplates, for example, the substitution of at least one hydrophilic residue such as, for example, between arginine and lysine, between glutamine and asparagine, and between glycine and serine (see U.S. Pat. Nos. 6,004,925, 6,037,323 and 6,046,166). The term "isoform" refers to a protein having the same, greater or partial function and similar, identical or partial sequence, and may or may not be the product of the same gene and usually tissue specific (see Weisgraber 1990, J. Lipid Res. 31(8):1503-11; Hixson and Powers 1991, J. Lipid Res. 32(9):1529-35; Lackner et al., 1985, J. Biol. Chem. 260(2):703-6; Hoeg et al., 1986, J. Biol. Chem. 261(9):3911-4; Gordon et al., 1984, J. Biol. Chem. 259(1):468-74; Powell et al., 1987, Cell 50(6):831-40; Aviram et al., 1998, Arterioscler. Thromb. Vase. Biol. 18(10):1617-24; Aviram et al., 1998, J. Clin. Invest. 101(8):1581-90; Billecke et al., 2000, Drug Metab. Dispos. 28(11):1335-42; Draganov et al., 2000, J. Biol. Chem. 275(43):33435-42; Steinmetz and Utermann 1985, J. Biol. Chem. 260(4):2258-64; Widler et al., 1980, J. Biol. Chem. 255(21):10464-71; Dyer et al., 1995, J. Lipid Res. 36(1):80-8; Sacre et al., 2003, FEBS Lett. 540(1-3):181-7; Weers, et al., 2003, Biophys. Chem. 100(1-3):481-92; Gong et al., 2002, J. Biol. Chem. 277(33):29919-26; Ohta et al., 1984, J. Biol. Chem. 259(23):14888-93 and U.S. Pat. No. 6,372,886).

In certain embodiments, the methods and compositions of the present invention include the use of a chimeric construction of an apolipoprotein. For example, a chimeric construction of an apolipoprotein can be comprised of an apolipoprotein domain with high lipid binding capacity associated with an apolipoprotein domain containing ischemia reperfusion protective properties. A chimeric construction of an apolipoprotein can be a construction that includes separate regions within an apolipoprotein (i.e., homologous construction) or a chimeric construction can be a construction that includes separate regions between different apolipoproteins (i.e., heterologous constructions). Compositions comprising a chimeric construction can also include segments that are apolipoprotein variants or segments designed to have a specific character (e.g., lipid binding, receptor binding, enzymatic, enzyme activating, antioxidant or reduction-oxidation property) (see Weisgraber 1990, J. Lipid Res. 31(8):1503-11; Hixson and Powers 1991, J. Lipid Res. 32(9):1529-35; Lackner et al., 1985, J. Biol. Chem. 260(2):703-6; Hoeg et al., 1986, J. Biol. Chem. 261(9):3911-4; Gordon et al., 1984, J. Biol. Chem. 259(1):468-74; Powell et al., 1987, Cell 50(6): 831-40; Aviram et al., 1998, Arterioscler. Thromb. Vasc. Biol. 18(10):1617-24; Aviram et al., 1998, J. Clin. Invest. 101(8): 1581-90; Billecke et al., 2000, Drug Metab. Dispos. 28(11): 1335-42; Draganov et al., 2000, J. Biol. Chem. 275(43): 33435-42; Steinmetz and Utermann 1985, J. Biol. Chem. 260(4):2258-64; Widler et al., 1980, J. Biol. Chem. 255(21): 10464-71; Dyer et al., 1995, J. Lipid Res. 36(1):80-8; Sorenson et al., 1999, Arterioscler. Thromb. Vasc. Biol. 19(9):2214-25; Palgunachari 1996, Arterioscler. Throb. Vasc. Biol. 16(2): 328-38: Thurberg et al., J. Biol. Chem. 271(11):6062-70; Dyer 1991, J. Biol. Chem. 266(23):150009-15; Hill 1998, J. Biol. Chem. 273(47):30979-84).

Apolipoproteins utilized in the invention also include recombinant, synthetic, semi-synthetic or purified apolipoproteins. Methods for obtaining apolipoproteins or equivalents thereof, utilized by the invention are well-known in the art. For example, apolipoproteins can be separated from plasma or natural products by, for example, density gradient centrifugation or immunoaffinity chromatography, or produced synthetically, semi-synthetically or using recombinant DNA techniques known to those of the art (see, e.g., Mulugeta et al., 1998, J. Chromatogr. 798(1-2): 83-90; Chung et al., 1980, J. Lipid Res. 21(3):284-91; Cheung et al., 1987, J. Lipid Res. 28(8):913-29; Persson, et al., 1998, J. Chromatogr. 711: 97-109; U.S. Pat. Nos. 5,059,528, 5,834,596, 5,876,968 and 5,721,114; and PCT Publications WO 86/04920 and WO 87/02062).

Apolipoproteins utilized in the invention further include apolipoprotein agonists such as peptides and peptide analogues that mimic the activity of ApoA-I, ApoA-I Milano (ApoA-$I_M$), ApoA-I Paris (ApoA-$I_P$), ApoA-II, ApoA-IV, and ApoE. For example, the apolipoprotein can be any of those described in U.S. Pat. Nos. 6,004,925, 6,037,323, 6,046,166, and 5,840,688, the contents of which are incorporated herein by reference in their entireties.

Apolipoprotein agonist peptides or peptide analogues can be synthesized or manufactured using any technique for peptide synthesis known in the art including, e.g., the techniques described in U.S. Pat. Nos. 6,004,925, 6,037,323 and 6,046, 166. For example, the peptides may be prepared using the solid-phase synthetic technique initially described by Merrifield (1963, J. Am. Chem. Soc. 85:2149-2154). Other peptide synthesis techniques may be found in Bodanszky et al., Peptide Synthesis, John Wiley & Sons, 2d Ed., (1976) and other references readily available to those skilled in the art. A summary of polypeptide synthesis techniques can be found in Stuart and Young, Solid Phase Peptide. Synthesis, Pierce Chemical Company, Rockford, Ill., (1984). Peptides may also be synthesized by solution methods as described in The Proteins, Vol. II, 3d Ed., Neurath et al., Eds., p. 105-237, Academic Press, New York, N.Y. (1976). Appropriate protective groups for use in different peptide syntheses are described in the above-mentioned texts as well as in McOmie, Protective Groups in Organic Chemistry, Plenum Press, New York, N.Y. (1973). The peptides of the present invention might also be prepared by chemical or enzymatic cleavage from larger portions of, for example, apolipoprotein A-I.

In certain embodiments, the apolipoprotein can be a mixture of apolipoproteins. In one embodiment, the apolipoprotein can be a homogeneous mixture, that is, a single type of apolipoprotein. In another embodiment, the apolipoprotein can be a heterogeneous mixture of apolipoproteins, that is, a mixture of two or more different apolipoproteins. Embodiments of heterogeneous mixtures of apolipoproteins can comprise, for example, a mixture of an apolipoprotein from an animal source and an apolipoprotein from a semi-synthetic source. In certain embodiments, a heterogeneous mixture can comprise, for example, a mixture of ApoA-I and ApoA-I Milano. In certain embodiments, a heterogeneous mixture can comprise, for example, a mixture of ApoA-I Milano and ApoA-I Paris. Suitable mixtures for use in the methods and compositions of the invention will be apparent to one of skill in the art.

If the apolipoprotein is obtained from natural sources, it can be obtained from a plant or animal source. If the apolipoprotein is obtained from an animal source, the apolipoprotein can be from any species. In certain embodiments, the apolipoprotein can be obtained from an animal source. In certain embodiments, the apolipoprotein can be obtained from a human source. In preferred embodiments of the invention, the apolipoprotein is derived from the same species as the individual to which the apolipoprotein is administered.

Other Components

In numerous embodiments, amphipathic lipids are included in lipid particles of the invention. "Amphipathic lipids" refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatdylcholine, lysophosphatidylcholine, lysophosphatidylethanolamine, dipalmitoylphosphatidylcholine, dioleoylphosphatidylcholine, distearoylphosphatidylcholine, or dilinoleylphosphatidylcholine. Other phosphorus-lacking compounds, such as sphingolipids, glycosphingolipid families, diacylglycerols, and β-acyloxyacids, can also be used. Additionally, such amphipathic lipids can be readily mixed with other lipids, such as triglycerides and sterols.

Also suitable for inclusion in the lipid particles of the invention are programmable fusion lipids. Such lipid particles have little tendency to fuse with cell membranes and deliver their payload until a given signal event occurs. This allows the lipid particle to distribute more evenly after injection into an organism or disease site before it starts fusing with cells. The signal event can be, for example, a change in pH, temperature, ionic environment, or time. In the latter case, a fusion delaying or "cloaking" component, such as an ATTA-lipid conjugate or a PEG-lipid conjugate, can simply exchange out of the lipid particle membrane over time. Exemplary lipid anchors include those having lengths of from about $C_{14}$ to about $C_{22}$, preferably from about $C_{14}$ to about $C_{16}$. In some embodiments, a PEG moiety, for example an mPEG-$NH_2$, has a size of about 1000, 2000, 5000, 10,000, 15,000 or 20,000 Daltons.

A lipid particle conjugated to a nucleic acid agent can also include a targeting moiety, e.g., a targeting moiety that is specific to a cell type or tissue. Targeting of lipid particles using a variety of targeting moieties, such as ligands, cell surface receptors, glycoproteins, vitamins (e.g., riboflavin) and monoclonal antibodies, has been previously described (see, e.g., U.S. Pat. Nos. 4,957,773 and 4,603,044). The targeting moieties can include the entire protein or fragments thereof. Targeting mechanisms generally require that the targeting agents be positioned on the surface of the lipid particle in such a manner that the targeting moiety is available for interaction with the target, for example, a cell surface receptor. A variety of different targeting agents and methods are known and available in the art, including those described, e.g., in Sapra, P. and Allen, T M, Prog. Lipid Res. 42(5):439-62 (2003); and Abra, R M et al., J. Liposome Res. 12:1-3, (2002).

The use of lipid particles, i.e., liposomes, with a surface coating of hydrophilic polymer chains, such as polyethylene glycol (PEG) chains, for targeting has been proposed (Allen, et al., Biochimica et Biophysica Acta 1237: 99-108 (1995); DeFrees, et al., Journal of the American Chemistry Society 118: 6101-6104 (1996); Blume, et al., Biochimica et Biophysica Acta 1149: 180-184 (1993); Klibanov, et al., Journal of Liposome Research 2: 321-334 (1992); U.S. Pat. No. 5,013, 556; Zalipsky, Bioconjugate Chemistry 4: 296-299 (1993); Zalipsky, FEBS Letters 353: 71-74 (1994); Zalipsky, in Stealth Liposomes Chapter 9 (Lasic and Martin, Eds) CRC Press, Boca Raton Fla. (1995). In one approach, a ligand, such as an antibody, for targeting the lipid particle is linked to the polar head group of lipids forming the lipid particle. In another approach, the targeting ligand is attached to the distal ends of the PEG chains forming the hydrophilic polymer coating (Klibanov, et al., Journal of Liposome Research 2: 321-334 (1992); Kirpotin et al., FEBS Letters 388: 115-118 (1996)).

Standard methods for coupling the target agents can be used. For example, phosphatidylethanolamine, which can be activated for attachment of target agents, or derivatized lipophilic compounds, such as lipid-derivatized bleomycin, can be used. Antibody-targeted liposomes can be constructed using, for instance, liposomes that incorporate protein A (see, Renneisen, et al., J. Bio. Chem., 265:16337-16342 (1990) and Leonetti, et al., Proc. Natl. Acad. Sci. (USA), 87:2448-2451 (1990). Other examples of antibody conjugation are disclosed in U.S. Pat. No. 6,027,726, the teachings of which are incorporated herein by reference. Examples of targeting moieties can also include other proteins, specific to cellular components, including antigens associated with neoplasms or tumors. Proteins used as targeting moieties can be attached to the liposomes via covalent bonds (see, Heath, *Covalent Attachment of Proteins to Liposomes*, 149 Methods in Enzymology 111-119 (Academic Press, Inc. 1987)). Other targeting methods include the biotin-avidin system.

Production of Nucleic Acid-Lipid Particles

In one embodiment, the nucleic acid-lipid particle formulations of the invention are produced via an extrusion method or an in-line mixing method.

The extrusion method (also referred to as preformed method or batch process) is a method where the empty liposomes (i.e. no nucleic acid) are prepared first, followed by the addition of nucleic acid to the empty liposome. Extrusion of liposome compositions through a small-pore polycarbonate membrane or an asymmetric ceramic membrane results in a relatively well-defined size distribution. Typically, the suspension is cycled through the membrane one or more times until the desired liposome complex size distribution is achieved. The liposomes may be extruded through successively smaller-pore membranes, to achieve a gradual reduction in liposome size. In some instances, the lipid-nucleic acid compositions which are formed can be used without any sizing. These methods are disclosed in the U.S. Pat. No. 5,008,050; U.S. Pat. No. 4,927,637; U.S. Pat. No. 4,737,323; *Biochim Biophys Acta*. 1979 Oct. 19; 557(1):9-23; *Biochim Biophys Acta*. 1980 Oct. 2; 601(3):559-7; *Biochim Biophys Acta*. 1986 Jun. 13; 858(1):161-8; and *Biochim. Biophys. Acta* 1985 812, 55-65, which are hereby incorporated by reference in their entirety.

The in-line mixing method is a method wherein both the lipids and the nucleic acid are added in parallel into a mixing chamber. The mixing chamber can be a simple T-connector or any other mixing chamber that is known to one skill in the art. These methods are disclosed in U.S. Pat. Nos. 6,534,018 and 6,855,277; US publication 2007/0042031 and *Pharmaceuticals Research*, Vol. 22, No. 3, March 2005, p. 362-372, which are hereby incorporated by reference in their entirety.

It is further understood that the formulations of the invention can be prepared by any methods known to one of ordinary skill in the art.

Characterization of Nucleic Acid-Lipid Particles

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total siRNA concentration in the formulation, as well as the entrapped fraction, is estimated using a dye exclusion assay. A sample of the formulated siRNA can be incubated with an RNA-binding dye, such as Ribogreen (Molecular Probes) in the presence or absence of a formulation disrupting surfactant, e.g., 0.5% Triton-X100. The total siRNA in the formulation can be determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. In one embodiment, the formulations of the invention are entrapped by at least 75%, at least 80% or at least 90%.

For nucleic acid-lipid particle formulations, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Formulations of Nucleic Acid-Lipid Particles

LNP01

One example of synthesis of a nucleic acid-lipid particle is as follows. Nucleic acid-lipid particles are synthesized using the lipidoid ND98.4HCl (MW 1487) (Formula 1), Cholesterol (Sigma-Aldrich), and PEG-Ceramide C16 (Avanti Polar Lipids). This nucleic acid-lipid particle is sometimes referred to as a LNP01 particle. Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous siRNA (e.g., in sodium acetate pH 5) such that the final ethanol concentration is about 35-45% and the final sodium acetate concentration is about 100-300 mM. Lipid-siRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

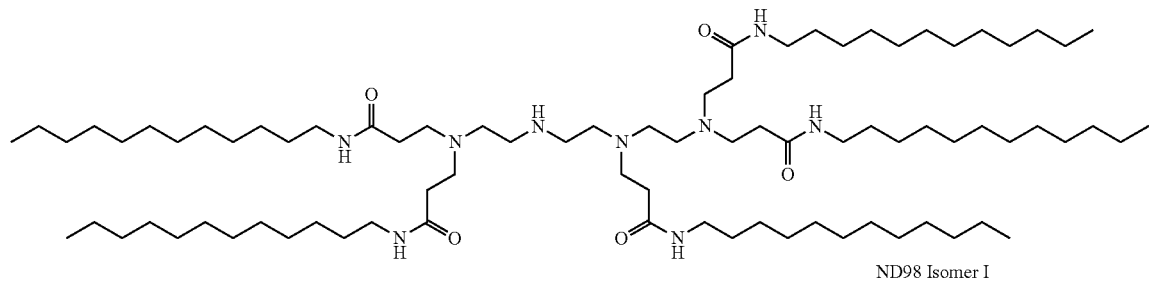

ND98 Isomer I

LNP01 formulations are described, e.g., in International Application Publication No. WO 2008/042973, which is hereby incorporated by reference.

Additional exemplary nucleic acid-lipid particle formulations are described in the following table. It is to be understood that the name of the nucleic acid-lipid particle in the table is not meant to be limiting. For example, as used herein, the term SNALP refers to formulations that include the cationic lipid DLinDMA.

| Name | cationic lipid/non-cationic lipid/cholesterol/PEG-lipid conjugate mol % ratio Lipid:siRNA ratio |
|---|---|
| SNALP | DLinDMA/DPPC/Cholesterol/PEG-cDMA (57.1/7.1/34.4/1.4) lipid:siRNA ~7:1 |
| LNP-S-X | XTC/DPPC/Cholesterol/PEG-cDMA 57.1/7.1/34.4/1.4 lipid:siRNA ~7:1 |
| LNP05 | XTC/DSPC/Cholesterol/PEG-DMG 57.5/7.5/31.5/3.5 lipid:siRNA ~6:1 |
| LNP06 | XTC/DSPC/Cholesterol/PEG-DMG 57.5/7.5/31.5/3.5 lipid:siRNA ~11:1 |
| LNP07 | XTC/DSPC/Cholesterol/PEG-DMG 60/7.5/31/1.5, lipid:siRNA ~6:1 |
| LNP08 | XTC/DSPC/Cholesterol/PEG-DMG 60/7.5/31/1.5, lipid:siRNA ~11:1 |
| LNP09 | XTC/DSPC/Cholesterol/PEG-DMG 50/10/38.5/1.5 lipid:siRNA ~10:1 |
| LNP10 | ALNY-100/DSPC/Cholesterol/PEG-DMG 50/10/38.5/1.5 lipid:siRNA ~10:1 |
| LNP11 | MC3/DSPC/Cholesterol/PEG-DMG 50/10/38.5/1.5 lipid:siRNA ~10:1 |
| LNP13 | XTC/DSPC/Cholesterol/PEG-DMG 50/10/38.5/1.5 lipid:siRNA ~33:1 |
| LNP14 | MC3/DSPC/Cholesterol/PEG-DMG 40/15/40/5 lipid:siRNA ~11:1 |
| LNP15 | MC3/DSPC/Cholesterol/PEG-DSG/GalNAc-PEG-DSG 50/10/35/4.5/0.5 lipid:siRNA ~11:1 |
| LNP16 | MC3/DSPC/Cholesterol/PEG-DMG 50/10/38.5/1.5 lipid:siRNA ~7:1 |
| LNP17 | MC3/DSPC/Cholesterol/PEG-DSG 50/10/38.5/1.5 lipid:siRNA ~10:1 |
| LNP18 | MC3/DSPC/Cholesterol/PEG-DMG 50/10/38.5/1.5 lipid:siRNA ~12:1 |
| LNP19 | MC3/DSPC/Cholesterol/PEG-DMG 50/10/35/5 lipid:siRNA ~8:1 |
| LNP20 | MC3/DSPC/Cholesterol/PEG-DPG 50/10/38.5/1.5 lipid:siRNA ~10:1 |
| LNP22 | XTC/DSPC/Cholesterol/PEG-DSG 50/10/38.5/1.5 lipid:siRNA ~10:1 |

XTC comprising formulations are described, e.g., in U.S. Provisional Ser. No. 61/239,686, filed Sep. 3, 2009, which is hereby incorporated by reference.

MC3 comprising formulations are described, e.g., in U.S. Provisional Ser. No. 61/244,834, filed Sep. 22, 2009, and U.S. Provisional Ser. No. 61/185,800, filed Jun. 10, 2009, which are hereby incorporated by reference.

ALNY-100 comprising formulations are described, e.g., International patent application number PCT/US09/63933, filed on Nov. 10, 2009, which is hereby incorporated by reference.

Additional representative formulations delineated in Tables 11 and 12. Lipid refers to a cationic lipid.

TABLE 11

Composition of exemplary nucleic acid-lipid particle (mole %) prepared via extrusion methods.

| Lipid (mol %) | DSPC (mol %) | Chol (mol %) | PEG (mol %) | Lipid/siRNA |
|---|---|---|---|---|
| 20 | 30 | 40 | 10 | 2.13 |
| 20 | 30 | 40 | 10 | 2.35 |
| 20 | 30 | 40 | 10 | 2.37 |
| 20 | 30 | 40 | 10 | 3.23 |
| 20 | 30 | 40 | 10 | 3.91 |
| 30 | 20 | 40 | 10 | 2.89 |
| 30 | 20 | 40 | 10 | 3.34 |
| 30 | 20 | 40 | 10 | 3.34 |
| 30 | 20 | 40 | 10 | 4.10 |
| 30 | 20 | 40 | 10 | 5.64 |
| 40 | 10 | 40 | 10 | 3.02 |
| 40 | 10 | 40 | 10 | 3.35 |
| 40 | 10 | 40 | 10 | 3.74 |
| 40 | 10 | 40 | 10 | 5.80 |
| 40 | 10 | 40 | 10 | 8.00 |
| 45 | 5 | 40 | 10 | 3.27 |
| 45 | 5 | 40 | 10 | 3.30 |
| 45 | 5 | 40 | 10 | 4.45 |
| 45 | 5 | 40 | 10 | 7.00 |
| 45 | 5 | 40 | 10 | 9.80 |
| 50 | 0 | 40 | 10 | 27.03 |
| 20 | 35 | 40 | 5 | 3.00 |
| 20 | 35 | 40 | 5 | 3.32 |
| 20 | 35 | 40 | 5 | 3.05 |
| 20 | 35 | 40 | 5 | 3.67 |
| 20 | 35 | 40 | 5 | 4.71 |
| 30 | 25 | 40 | 5 | 2.47 |
| 30 | 25 | 40 | 5 | 2.98 |
| 30 | 25 | 40 | 5 | 3.29 |
| 30 | 25 | 40 | 5 | 4.99 |
| 30 | 25 | 40 | 5 | 7.15 |
| 40 | 15 | 40 | 5 | 2.79 |
| 40 | 15 | 40 | 5 | 3.29 |
| 40 | 15 | 40 | 5 | 4.33 |
| 40 | 15 | 40 | 5 | 7.05 |
| 40 | 15 | 40 | 5 | 9.63 |
| 45 | 10 | 40 | 5 | 2.44 |
| 45 | 10 | 40 | 5 | 3.21 |
| 45 | 10 | 40 | 5 | 4.29 |
| 45 | 10 | 40 | 5 | 6.50 |
| 45 | 10 | 40 | 5 | 8.67 |
| 20 | 35 | 40 | 5 | 4.10 |
| 20 | 35 | 40 | 5 | 4.83 |
| 30 | 25 | 40 | 5 | 3.86 |
| 30 | 25 | 40 | 5 | 5.38 |
| 30 | 25 | 40 | 5 | 7.07 |
| 40 | 15 | 40 | 5 | 3.85 |
| 40 | 15 | 40 | 5 | 4.88 |
| 40 | 15 | 40 | 5 | 7.22 |
| 40 | 15 | 40 | 5 | 9.75 |
| 45 | 10 | 40 | 5 | 2.83 |
| 45 | 10 | 40 | 5 | 3.85 |
| 45 | 10 | 40 | 5 | 4.88 |
| 45 | 10 | 40 | 5 | 7.05 |
| 45 | 10 | 40 | 5 | 9.29 |
| 45 | 20 | 30 | 5 | 4.01 |
| 45 | 20 | 30 | 5 | 3.70 |
| 50 | 15 | 30 | 5 | 4.75 |
| 50 | 15 | 30 | 5 | 3.80 |
| 55 | 10 | 30 | 5 | 3.85 |
| 55 | 10 | 30 | 5 | 4.13 |
| 60 | 5 | 30 | 5 | 5.09 |
| 60 | 5 | 30 | 5 | 4.67 |
| 65 | 0 | 30 | 5 | 4.75 |
| 65 | 0 | 30 | 5 | 6.06 |

TABLE 11-continued

Composition of exemplary nucleic acid-lipid particle (mole %) prepared via extrusion methods.

| Lipid (mol %) | DSPC (mol %) | Chol (mol %) | PEG (mol %) | Lipid/siRNA |
|---|---|---|---|---|
| 56.5 | 10 | 30 | 3.5 | 3.70 |
| 56.5 | 10 | 30 | 3.5 | 3.56 |
| 57.5 | 10 | 30 | 2.5 | 3.48 |
| 57.5 | 10 | 30 | 2.5 | 3.20 |
| 58.5 | 10 | 30 | 1.5 | 3.24 |
| 58.5 | 10 | 30 | 1.5 | 3.13 |
| 59.5 | 10 | 30 | 0.5 | 3.24 |
| 59.5 | 10 | 30 | 0.5 | 3.03 |
| 45 | 10 | 40 | 5 | 7.57 |
| 45 | 10 | 40 | 5 | 7.24 |
| 45 | 10 | 40 | 5 | 7.48 |
| 45 | 10 | 40 | 5 | 7.84 |
| 65 | 0 | 30 | 5 | 4.01 |
| 60 | 5 | 30 | 5 | 3.70 |
| 55 | 10 | 30 | 5 | 3.65 |
| 50 | 10 | 35 | 5 | 3.43 |
| 50 | 15 | 30 | 5 | 3.80 |
| 45 | 15 | 35 | 5 | 3.70 |
| 45 | 20 | 30 | 5 | 3.75 |
| 45 | 25 | 25 | 5 | 3.85 |
| 55 | 10 | 32.5 | 2.5 | 3.61 |
| 60 | 10 | 27.5 | 2.5 | 3.65 |
| 60 | 10 | 25 | 5 | 4.07 |
| 55 | 5 | 38.5 | 1.5 | 3.75 |
| 60 | 10 | 28.5 | 1.5 | 3.43 |
| 55 | 10 | 33.5 | 1.5 | 3.48 |
| 60 | 5 | 33.5 | 1.5 | 3.43 |
| 55 | 5 | 37.5 | 2.5 | 3.75 |
| 60 | 5 | 32.5 | 2.5 | 4.52 |
| 60 | 5 | 32.5 | 2.5 | 3.52 |
| 45 | 15 (DMPC) | 35 | 5 | 3.20 |
| 45 | 15 (DPPC) | 35 | 5 | 3.43 |
| 45 | 15 (DOPC) | 35 | 5 | 4.52 |
| 45 | 15 (POPC) | 35 | 5 | 3.85 |
| 55 | 5 | 37.5 | 2.5 | 3.96 |
| 55 | 10 | 32.5 | 2.5 | 3.56 |
| 60 | 5 | 32.5 | 2.5 | 3.80 |
| 60 | 10 | 27.5 | 2.5 | 3.75 |
| 60 | 5 | 30 | 5 | 4.19 |
| 60 | 5 | 33.5 | 1.5 | 3.48 |
| 60 | 5 | 33.5 | 1.5 | 6.64 |
| 60 | 5 | 30 | 5 | 3.90 |
| 60 | 5 | 30 | 5 | 4.65 |
| 60 | 5 | 30 | 5 | 5.88 |
| 60 | 5 | 30 | 5 | 7.51 |
| 60 | 5 | 30 | 5 | 9.51 |
| 60 | 5 | 30 | 5 | 11.06 |
| 62.5 | 2.5 | 50 | 5 | 6.63 |
| 45 | 15 | 35 | 5 | 3.31 |
| 45 | 15 | 35 | 5 | 6.80 |
| 60 | 5 | 25 | 10 | 6.48 |
| 60 | 5 | 32.5 | 2.5 | 3.43 |
| 60 | 5 | 30 | 5 | 3.90 |
| 60 | 5 | 30 | 5 | 7.61 |
| 45 | 15 | 35 | 5 | 3.13 |
| 45 | 15 | 35 | 5 | 6.42 |
| 60 | 5 | 25 | 10 | 6.48 |
| 60 | 5 | 32.5 | 2.5 | 3.03 |
| 60 | 5 | 30 | 5 | 3.43 |
| 60 | 5 | 30 | 5 | 6.72 |
| 60 | 5 | 30 | 5 | 4.13 |
| 70 | 5 | 20 | 5 | 5.48 |
| 80 | 5 | 10 | 5 | 5.94 |
| 90 | 5 | 0 | 5 | 9.50 |
| 60 | 5 | 30 | 5 C12PEG | 3.85 |
| 60 | 5 | 30 | 5 | 3.70 |
| 60 | 5 | 30 | 5 C16PEG | 3.80 |
| 60 | 5 | 30 | 5 | 4.19 |
| 60 | 5 | 29 | 5 | 4.07 |
| 60 | 5 | 30 | 5 | 3.56 |
| 60 | 5 | 30 | 5 | 3.39 |
| 60 | 5 | 30 | 5 | 3.96 |
| 60 | 5 | 30 | 5 | 4.01 |
| 60 | 5 | 30 | 5 | 4.07 |
| 60 | 5 | 30 | 5 | 4.25 |
| 60 | 5 | 30 | 5 | 3.80 |
| 60 | 5 | 30 | 5 | 3.31 |
| 60 | 5 | 30 | 5 | 4.83 |
| 60 | 5 | 30 | 5 | 4.67 |
| 60 | 5 | 30 | 5 | 3.96 |
| 57.5 | 7.5 | 33.5 | 1.5 | 3.39 |
| 57.5 | 7.5 | 32.5 | 2.5 | 3.39 |
| 57.5 | 7.5 | 31.5 | 3.5 | 3.52 |
| 57.5 | 7.5 | 30 | 5 | 4.19 |
| 60 | 5 | 30 | 5 | 3.96 |
| 60 | 5 | 30 | 5 | 3.96 |
| 60 | 5 | 30 | 5 | 3.56 |
| 60 | 5 | 33.5 | 1.5 | 3.52 |
| 60 | 5 | 25 | 10 | 5.18 |
| 60 | 5 (DPPC) | 30 | 5 | 4.25 |
| 60 | 5 | 32.5 | 2.5 | 3.70 |
| 57.5 | 7.5 | 31.5 | 3.5 | 3.06 |
| 57.5 | 7.5 | 31.5 | 3.5 | 3.65 |
| 57.5 | 7.5 | 31.5 | 3.5 | 4.70 |
| 57.5 | 7.5 | 31.5 | 3.5 | 6.56 |

TABLE 12

Composition of exemplary nucleic acid-lipid particles prepared via in-line mixing

| Lipid (mol %) | DSPC (mol %) | Chol (mol %) | PEG (mol %) | Lipid A/siRNA |
|---|---|---|---|---|
| 55 | 5 | 37.5 | 2.5 | 3.96 |
| 55 | 10 | 32.5 | 2.5 | 3.56 |
| 60 | 5 | 32.5 | 2.5 | 3.80 |
| 60 | 10 | 27.5 | 2.5 | 3.75 |
| 60 | 5 | 30 | 5 | 4.19 |
| 60 | 5 | 33.5 | 1.5 | 3.48 |
| 60 | 5 | 33.5 | 1.5 | 6.64 |
| 60 | 5 | 25 | 10 | 6.79 |
| 60 | 5 | 32.5 | 2.5 | 3.96 |
| 60 | 5 | 34 | 1 | 3.75 |
| 60 | 5 | 34.5 | 0.5 | 3.28 |
| 50 | 5 | 40 | 5 | 3.96 |
| 60 | 5 | 30 | 5 | 4.75 |
| 70 | 5 | 20 | 5 | 5.00 |
| 80 | 5 | 10 | 5 | 5.18 |
| 60 | 5 | 30 | 5 | 13.60 |
| 60 | 5 | 30 | 5 | 14.51 |
| 60 | 5 | 30 | 5 | 6.20 |
| 60 | 5 | 30 | 5 | 4.60 |
| 60 | 5 | 30 | 5 | 6.20 |
| 60 | 5 | 30 | 5 | 5.82 |
| 40 | 5 | 54 | 1 | 3.39 |
| 40 | 7.5 | 51.5 | 1 | 3.39 |
| 40 | 10 | 49 | 1 | 3.39 |
| 50 | 5 | 44 | 1 | 3.39 |
| 50 | 7.5 | 41.5 | 1 | 3.43 |
| 50 | 10 | 39 | 1 | 3.35 |
| 60 | 5 | 34 | 1 | 3.52 |
| 60 | 7.5 | 31.5 | 1 | 3.56 |
| 60 | 10 | 29 | 1 | 3.80 |
| 70 | 5 | 24 | 1 | 3.70 |
| 70 | 7.5 | 21.5 | 1 | 4.13 |
| 70 | 10 | 19 | 1 | 3.85 |
| 60 | 5 | 34 | 1 | 3.52 |
| 60 | 5 | 34 | 1 | 3.70 |
| 60 | 5 | 34 | 1 | 3.52 |
| 60 | 7.5 | 27.5 | 5 | 5.18 |
| 60 | 7.5 | 29 | 3.5 | 4.45 |
| 60 | 5 | 31.5 | 3.5 | 4.83 |
| 60 | 7.5 | 31 | 1.5 | 3.48 |
| 57.5 | 7.5 | 30 | 5 | 4.75 |

TABLE 12-continued

Composition of exemplary nucleic acid-lipid particles prepared via in-line mixing

| Lipid (mol %) | DSPC (mol %) | Chol (mol %) | PEG (mol %) | Lipid A/siRNA |
|---|---|---|---|---|
| 57.5 | 7.5 | 31.5 | 3.5 | 4.83 |
| 57.5 | 5 | 34 | 3.5 | 4.67 |
| 57.5 | 7.5 | 33.5 | 1.5 | 3.43 |
| 55 | 7.5 | 32.5 | 5 | 4.38 |
| 55 | 7.5 | 34 | 3.5 | 4.13 |
| 55 | 5 | 36.5 | 3.5 | 4.38 |
| 55 | 7.5 | 36 | 1.5 | 3.35 |

Synthesis of Cationic Lipids.

Any of the compounds, e.g., cationic lipids and the like, used in the nucleic acid-lipid particles of the invention may be prepared by known organic synthesis techniques, including the methods described in more detail in the Examples. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tent-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$, wherein n is 0, 1 or 2, R$^x$ and R$^y$ are the same or different and independently hydrogen, alkyl or heterocycle, and each of said alkyl and heterocycle substituents may be further substituted with one or more of oxo, halogen, —OH, —CN, alkyl, —OR$^x$, heterocycle, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$.

"Halogen" means fluoro, chloro, bromo and iodo.

In some embodiments, the methods of the invention may require the use of protecting groups. Protecting group methodology is well known to those skilled in the art (see, for example, PROTECTIVE GROUPS IN ORGANIC SYNTHESIS, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of MC3

Preparation of DLin-M-C3-DMA (i.e., (6Z,9Z,28Z,31Z)-heptatriaconta-6,9,28,31-tetraen-19-yl4-(dimethylamino) butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g). Further description is provided in WO 2010/054401 (PCTUS2009/063927 filed on Nov. 10, 2009 and U.S. patent application Ser. No. 12/813,448 filed on Jun. 10, 2010.

Synthesis of Formula A

In one embodiment, nucleic acid-lipid particles of the invention are formulated using a cationic lipid of formula A:

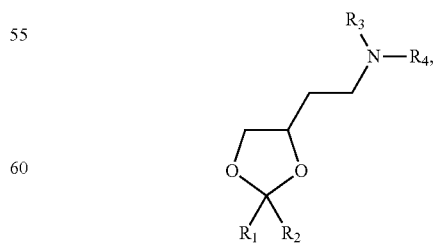

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above may be made by the following Reaction Schemes 1 or 2, wherein all substituents are as defined above unless indicated otherwise.

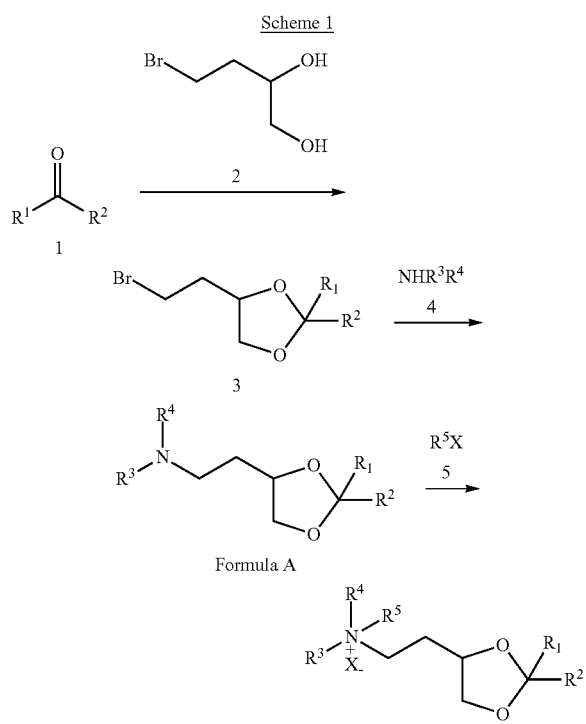

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

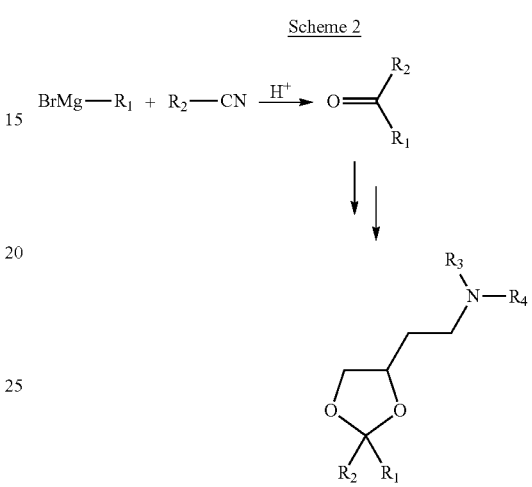

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of ALNY-100

Synthesis of ketal 519 [ALNY-100] was performed using the following scheme 3:

Scheme 3
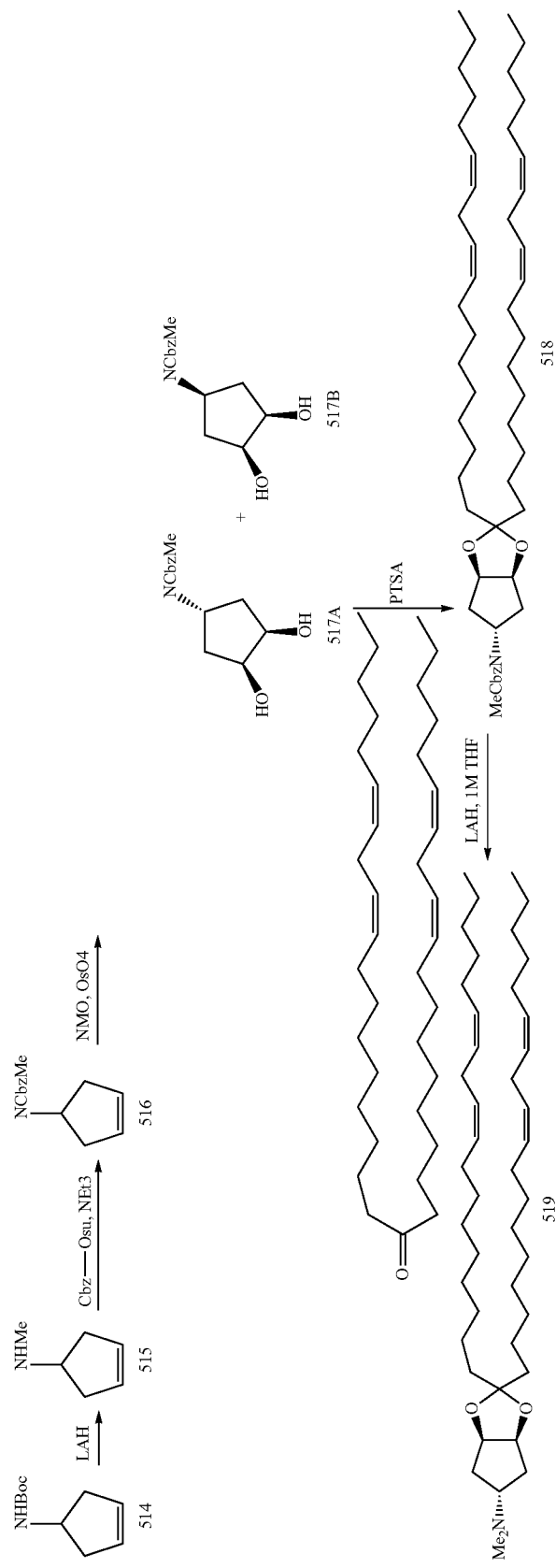

Synthesis of 515:

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H] −232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (1×50 mL). Organic phase was dried over an.Na2SO4 and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS-[M+H] −266.3, [M+NH4+] −283.5 present, HPLC-97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519:

A solution of compound 518 (1 eq) in hexane (15 mL) was added in a drop-wise fashion to an ice-cold solution of LAH in THF (1 M, 2 eq). After complete addition, the mixture was heated at 40 C over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+ Calc. 654.6. Found 654.6.

Therapeutic Agent-Lipid Particle Compositions and Formulations

The invention includes compositions comprising a lipid particle of the invention and an active agent, wherein the active agent is associated with the lipid particle. In particular embodiments, the active agent is a therapeutic agent. In particular embodiments, the active agent is encapsulated within an aqueous interior of the lipid particle. In other embodiments, the active agent is present within one or more lipid layers of the lipid particle. In other embodiments, the active agent is bound to the exterior or interior lipid surface of a lipid particle.

"Fully encapsulated" as used herein indicates that the nucleic acid in the particles is not significantly degraded after exposure to serum or a nuclease assay that would significantly degrade free DNA. In a fully encapsulated system, preferably less than 25% of particle nucleic acid is degraded in a treatment that would normally degrade 100% of free nucleic acid, more preferably less than 10% and most preferably less than 5% of the particle nucleic acid is degraded. Alternatively, full encapsulation may be determined by an Oligreen® assay. Oligreen® is an ultra-sensitive fluorescent nucleic acid stain for quantitating oligonucleotides and single-stranded DNA in solution (available from Invitrogen Corporation, Carlsbad, Calif.). Fully encapsulated also suggests that the particles are serum stable, that is, that they do not rapidly decompose into their component parts upon in vivo administration.

Active agents, as used herein, include any molecule or compound capable of exerting a desired effect on a cell, tissue, organ, or subject. Such effects may be biological, physiological, or cosmetic, for example. Active agents may be any type of molecule or compound, including e.g., nucleic acids, peptides and polypeptides, including, e.g., antibodies, such as, e.g., polyclonal antibodies, monoclonal antibodies, antibody fragments; humanized antibodies, recombinant antibodies, recombinant human antibodies, and Primatized™ antibodies, cytokines, growth factors, apoptotic factors, differentiation-inducing factors, cell surface receptors and their ligands; hormones; and small molecules, including small organic molecules or compounds.

In one embodiment, the active agent is a therapeutic agent, or a salt or derivative thereof. Therapeutic agent derivatives may be therapeutically active themselves or they may be prodrugs, which become active upon further modification. Thus, in one embodiment, a therapeutic agent derivative retains some or all of the therapeutic activity as compared to the unmodified agent, while in another embodiment, a therapeutic agent derivative lacks therapeutic activity.

In various embodiments, therapeutic agents include any therapeutically effective agent or drug, such as anti-inflammatory compounds, anti-depressants, stimulants, analgesics, antibiotics, birth control medication, antipyretics, vasodilators, anti-angiogenics, cytovascular agents, signal transduction inhibitors, cardiovascular drugs, e.g., anti-arrhythmic agents, vasoconstrictors, hormones, and steroids.

In certain embodiments, the therapeutic agent is an oncology drug, which may also be referred to as an anti-tumor drug, an anti-cancer drug, a tumor drug, an antineoplastic agent, or the like. Examples of oncology drugs that may be used according to the invention include, but are not limited to, adriamycin, alkeran, allopurinol, altretamine, amifostine, anastrozole, araC, arsenic trioxide, azathioprine, bexarotene, biCNU, bleomycin, busulfan intravenous, busulfan oral, capecitabine (Xeloda), carboplatin, carmustine, CCNU, celecoxib, chlorambucil, cisplatin, cladribine, cyclosporin A, cytarabine, cytosine arabinoside, daunorubicin, cytoxan, daunorubicin, dexamethasone, dexrazoxane, dodetaxel, doxorubicin, doxorubicin, DTIC, epirubicin, estramustine, etoposide phosphate, etoposide and VP-16, exemestane, FK506, fludarabine, fluorouracil, 5-FU, gemcitabine (Gemzar), gemtuzumab-ozogamicin, goserelin acetate, hydrea, hydroxyurea, idarubicin, ifosfamide, imatinib mesylate, interferon, irinotecan (Camptostar, CPT-111), letrozole, leucovorin, leustatin, leuprolide, levamisole, litretinoin, megastrol, melphalan, L-PAM, mesna, methotrexate, methoxsalen, mithramycin, mitomycin, mitoxantrone, nitrogen mustard, paclitaxel, pamidronate, Pegademase, pentostatin, porfimer sodium, prednisone, rituxan, streptozocin, STI-571, tamoxifen, taxotere, temozolamide, teniposide, VM-26, topotecan (Hycamtin), toremifene, tretinoin, ATRA, valrubicin, velban, vinblastine, vincristine, VP16, and vinorelbine. Other examples of oncology drugs that may be used according to the invention are ellipticin and ellipticin analogs or derivatives, epothilones, intracellular kinase inhibitors and camptothecins.

Additional Formulations

Emulsions

The compositions of the present invention may be prepared and formulated as emulsions. Emulsions are typically heterogeneous systems of one liquid dispersed in another in the form of droplets usually exceeding 0.1 μm in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, non-swelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

Large varieties of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture has been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-10}$ alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines) (Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers dsRNAs of the present invention can be formulated in a pharmaceutically acceptable carrier or diluent. A "pharmaceutically acceptable carrier" (also referred to herein as an "excipient") is a pharmaceutically acceptable solvent, suspending agent, or any other pharmacologically inert vehicle. Pharmaceutically acceptable carriers can be liquid or solid, and can be selected with the planned manner of administration in mind so as to provide for the desired bulk, consistency, and other pertinent transport and chemical properties. Typical pharmaceutically acceptable carriers include, by way of example and not limitation: water; saline solution; binding agents (e.g., polyvinylpyrrolidone or hydroxypropyl methylcellulose); fillers (e.g., lactose and other sugars, gelatin, or calcium sulfate); lubricants (e.g., starch, polyethylene glycol, or sodium acetate); disintegrates (e.g., starch or sodium starch glycolate); and wetting agents (e.g., sodium lauryl sulfate).

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The co-administration of a nucleic acid and a carrier compound, typically with an excess of the latter substance, can result in a substantial reduction of the amount of nucleic acid recovered in the liver, kidney or other extra-circulatory reservoirs, presumably due to competition between the carrier compound and the nucleic acid for a common receptor. For example, the recovery of a partially phosphorothioate dsRNA in hepatic tissue can be reduced when it is co-administered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

Combination Therapy

In one aspect, a composition of the invention can be used in combination therapy. The term "combination therapy" includes the administration of the subject compounds in further combination with other biologically active ingredients (such as, but not limited to, a second and different antineoplastic agent) and non-drug therapies (such as, but not limited to, surgery or radiation treatment). For instance, the compounds of the invention can be used in combination with other pharmaceutically active compounds, preferably compounds that are able to enhance the effect of the compounds of the invention. The compounds of the invention can be administered simultaneously (as a single preparation or separate preparation) or sequentially to the other drug therapy. In general, a combination therapy envisions administration of two or more drugs during a single cycle or course of therapy.

In one aspect of the invention, the subject compounds may be administered in combination with one or more separate agents that modulate protein kinases involved in various disease states. Examples of such kinases may include, but are not limited to: serine/threonine specific kinases, receptor tyrosine specific kinases and non-receptor tyrosine specific kinases. Serine/threonine kinases include mitogen activated protein kinases (MAPK), meiosis specific kinase (MEK), RAF and aurora kinase. Examples of receptor kinase families include epidermal growth factor receptor (EGFR) (e.g., HER2/neu, HER3, HER4, ErbB, ErbB2, ErbB3, ErbB4, Xmrk, DER, Let23); fibroblast growth factor (FGF) receptor (e.g. FGF-R1, GFF-R2/BEK/CEK3, FGF-R3/CEK2, FGF-R4/TKF, KGF-R); hepatocyte growth/scatter factor receptor (HGFR) (e.g., MET, RON, SEA, SEX); insulin receptor (e.g. IGFI-R); Eph (e.g. CEK5, CEK8, EBK, ECK, EEK, EHK-I, EHK-2, ELK, EPH, ERK, HEK, MDK2, MDK5, SEK); AxI (e.g. Mer/Nyk, Rse); RET; and platelet-derived growth factor receptor (PDGFR) (e.g. PDGFα-R, PDGIβ-R, CSFI-R/FMS, SCF-R/C-KIT, VEGF-R/FLT, NEK/FLK1, FLT3/FLK2/STK-1). Non-receptor tyrosine kinase families include, but are not limited to, BCR-ABL (e.g. $p43^{ab1}$, ARG); BTK (e.g. ITK/EMT, TEC); CSK, FAK, FPS, JAK, SRC, BMX, FER, CDK and SYK.

In another aspect of the invention, the subject compounds may be administered in combination with one or more agents that modulate non-kinase biological targets or processes.

Such targets include histone deacetylases (HDAC), DNA methyltransferase (DNMT), heat shock proteins (e.g., HSP90), and proteosomes.

In one embodiment, subject compounds may be combined with antineoplastic agents (e.g. small molecules, monoclonal antibodies, antisense RNA, and fusion proteins) that inhibit one or more biological targets such as Zolinza, Tarceva, Iressa, Tykerb, Gleevec, Sutent, Sprycel, Nexavar, Sorafenib, CNF2024, RG108, BMS387032, Affmitak, Avastin, Herceptin, Erbitux, AG24322, PD325901, ZD6474, PD 184322, Obatodax, ABT737 and AEE788. Such combinations may enhance therapeutic efficacy over efficacy achieved by any of the agents alone and may prevent or delay the appearance of resistant mutational variants.

In certain preferred embodiments, the compounds of the invention are administered in combination with a chemotherapeutic agent. Chemotherapeutic agents encompass a wide range of therapeutic treatments in the field of oncology. These agents are administered at various stages of the disease for the purposes of shrinking tumors, destroying remaining cancer cells left over after surgery, inducing remission, maintaining remission and/or alleviating symptoms relating to the cancer or its treatment. Examples of such agents include, but are not limited to, alkylating agents such as mustard gas derivatives (Mechlorethamine, cylophosphamide, chlorambucil, melphalan, ifosfamide), ethylenimines (thiotepa, hexamethylmelanine), Alkylsulfonates (Busulfan), Hydrazines and Triazines (Altretamine, Procarbazine, Dacarbazine and Temozolomide), Nitrosoureas (Carmustine, Lomustine and Streptozocin), Ifosfamide and metal salts (Carboplatin, Cisplatin, and Oxaliplatin); plant alkaloids such as Podophyllotoxins (Etoposide and Tenisopide), Taxanes (Paclitaxel and Docetaxel), Vinca alkaloids (Vincristine, Vinblastine, Vindesine and Vinorelbine), and Camptothecan analogs (Irinotecan and Topotecan); anti-tumor antibiotics such as Chromomycins (Dactinomycin and Plicamycin), Anthracyclines (Doxorubicin, Daunorubicin, Epirubicin, Mitoxantrone, Valrubicin and Idarubicin), and miscellaneous antibiotics such as Mitomycin, Actinomycin and Bleomycin; anti-metabolites such as folic acid antagonists (Methotrexate, Pemetrexed, Raltitrexed, Aminopterin), pyrimidine antagonists (5-Fluorouracil, Floxuridine, Cytarabine, Capecitabine, and Gemcitabine), purine antagonists (6-Mercaptopurine and 6-Thioguanine) and adenosine deaminase inhibitors (Cladribine, Fludarabine, Mercaptopurine, Clofarabine, Thioguanine, Nelarabine and Pentostatin); topoisomerase inhibitors such as topoisomerase I inhibitors (Ironotecan, topotecan) and topoisomerase II inhibitors (Amsacrine, etoposide, etoposide phosphate, teniposide); monoclonal antibodies (Alemtuzumab, Gemtuzumab ozogamicin, Rituximab, Trastuzumab, Ibritumomab Tioxetan, Cetuximab, Panitumumab, Tositumomab, Bevacizumab); and miscellaneous anti-neoplasties such as ribonucleotide reductase inhibitors (Hydroxyurea); adrenocortical steroid inhibitor (Mitotane); enzymes (Asparaginase and Pegaspargase); anti-microtubule agents (Estramustine); and retinoids (Bexarotene, Isotretinoin, Tretinoin (ATRA). In certain preferred embodiments, the compounds of the invention are administered in combination with a chemoprotective agent. Chemoprotective agents act to protect the body or minimize the side effects of chemotherapy. Examples of such agents include, but are not limited to, amfostine, mesna, and dexrazoxane.

In one aspect of the invention, the subject compounds are administered in combination with radiation therapy. Radiation is commonly delivered internally (implantation of radioactive material near cancer site) or externally from a machine that employs photon (x-ray or gamma-ray) or particle radiation. Where the combination therapy further comprises radiation treatment, the radiation treatment may be conducted at any suitable time so long as a beneficial effect from the co-action of the combination of the therapeutic agents and radiation treatment is achieved. For example, in appropriate cases, the beneficial effect is still achieved when the radiation treatment is temporally removed from the administration of the therapeutic agents, perhaps by days or even weeks.

It will be appreciated that compounds of the invention can be used in combination with an immunotherapeutic agent. One form of immunotherapy is the generation of an active systemic tumor-specific immune response of host origin by administering a vaccine composition at a site distant from the tumor. Various types of vaccines have been proposed, including isolated tumor-antigen vaccines and anti-idiotype vaccines. Another approach is to use tumor cells from the subject to be treated, or a derivative of such cells (reviewed by Schirrmacher et al. (1995) J. Cancer Res. Clin. Oncol. 121:487). In U.S. Pat. No. 5,484,596, Hanna Jr. et al. claim a method for treating a resectable carcinoma to prevent recurrence or metastases, comprising surgically removing the tumor, dispersing the cells with collagenase, irradiating the cells, and vaccinating the patient with at least three consecutive doses of about $10^7$ cells.

It will be appreciated that the compounds of the invention may advantageously be used in conjunction with one or more adjunctive therapeutic agents. Examples of suitable agents for adjunctive therapy include steroids, such as corticosteroids (amcinonide, betamethasone, betamethasone dipropionate, betamethasone valerate, budesonide, clobetasol, clobetasol acetate, clobetasol butyrate, clobetasol 17-propionate, cortisone, deflazacort, desoximetasone, diflucortolone valerate, dexamethasone, dexamethasone sodium phosphate, desonide, furoate, fluocinonide, fluocinolone acetonide, halcinonide, hydrocortisone, hydrocortisone butyrate, hydrocortisone sodium succinate, hydrocortisone valerate, methyl prednisolone, mometasone, prednicarbate, prednisolone, triamcinolone, triamcinolone acetonide, and halobetasol proprionate); a 5HTi agonist, such as a triptan (e.g. sumatriptan or naratriptan); an adenosine Al agonist; an EP ligand; an NMDA modulator, such as a glycine antagonist; a sodium channel blocker (e.g. lamotrigine); a substance P antagonist (e.g. an NKi antagonist); a cannabinoid; acetaminophen or phenacetin; a 5-lipoxygenase inhibitor; a leukotriene receptor antagonist; a DMARD (e.g. methotrexate); gabapentin and related compounds; a tricyclic antidepressant (e.g. amitryptilline); a neurone stabilizing antiepileptic drug; a mono-aminergic uptake inhibitor (e.g. venlafaxine); a matrix metalloproteinase inhibitor; a nitric oxide synthase (NOS) inhibitor, such as an iNOS or an nNOS inhibitor; an inhibitor of the release, or action, of tumour necrosis factor α; an antibody therapy, such as a monoclonal antibody therapy; an antiviral agent, such as a nucleoside inhibitor (e.g. lamivudine) or an immune system modulator (e.g. interferon); an opioid analgesic; a local anaesthetic; a stimulant, including caffeine; an H2-antagonist (e.g. ranitidine); a proton pump inhibitor (e.g. omeprazole); an antacid (e.g. aluminium or magnesium hydroxide); an antiflatulent (e.g. simethicone); a decongestant (e.g. phenylephrine, phenylpropanolamine, pseudoephedrine, oxymetazoline, epinephrine, naphazoline, xylometazoline, propylhexedrine, or levo-desoxyephedrine); an antitussive (e.g. codeine, hydrocodone, carmiphen, carbetapentane, or dextramethorphan); a diuretic; or a sedating or non-sedating antihistamine.

The compounds of the invention can be co-administered with siRNA that target other genes. For example, a compound of the invention can be co-administered with an siRNA targeted to a c-Myc gene. In one example, AD-12115 can be co-administered with a c-Myc siRNA. Examples of c-Myc targeted siRNAs are disclosed in U.S. patent application Ser. No. 12/373,039 which is herein incorporated by reference.

Methods of Preparing Lipid Particles

The methods and compositions of the invention make use of certain cationic lipids, the synthesis, preparation and characterization of which is described below and in the accompanying Examples. In addition, the present invention provides methods of preparing lipid particles, including those associated with a therapeutic agent, e.g., a nucleic acid. In the methods described herein, a mixture of lipids is combined with a buffered aqueous solution of nucleic acid to produce an intermediate mixture containing nucleic acid encapsulated in lipid particles wherein the encapsulated nucleic acids are present in a nucleic acid/lipid ratio of about 3 wt % to about 25 wt %, preferably 5 to 15 wt %. The intermediate mixture may optionally be sized to obtain lipid-encapsulated nucleic acid particles wherein the lipid portions are unilamellar vesicles, preferably having a diameter of 30 to 150 nm, more preferably about 40 to 90 nm. The pH is then raised to neutralize at least a portion of the surface charges on the lipid-nucleic acid particles, thus providing an at least partially surface-neutralized lipid-encapsulated nucleic acid composition.

As described above, several of these cationic lipids are amino lipids that are charged at a pH below the $pK_a$ of the amino group and substantially neutral at a pH above the $pK_a$. These cationic lipids are termed titratable cationic lipids and can be used in the formulations of the invention using a two-step process. First, lipid vesicles can be formed at the lower pH with titratable cationic lipids and other vesicle components in the presence of nucleic acids. In this manner, the vesicles will encapsulate and entrap the nucleic acids. Second, the surface charge of the newly formed vesicles can be neutralized by increasing the pH of the medium to a level above the $pK_a$ of the titratable cationic lipids present, i.e., to physiological pH or higher. Particularly advantageous aspects of this process include both the facile removal of any surface adsorbed nucleic acid and a resultant nucleic acid delivery vehicle which has a neutral surface. Liposomes or lipid particles having a neutral surface are expected to avoid rapid clearance from circulation and to avoid certain toxicities which are associated with cationic liposome preparations. Additional details concerning these uses of such titratable cationic lipids in the formulation of nucleic acid-lipid particles are provided in U.S. Pat. No. 6,287,591 and U.S. Pat. No. 6,858,225, incorporated herein by reference.

It is further noted that the vesicles formed in this manner provide formulations of uniform vesicle size with high content of nucleic acids. Additionally, the vesicles have a size range of from about 30 to about 150 nm, more preferably about 30 to about 90 nm.

Without intending to be bound by any particular theory, it is believed that the very high efficiency of nucleic acid encapsulation is a result of electrostatic interaction at low pH. At acidic pH (e.g. pH 4.0) the vesicle surface is charged and binds a portion of the nucleic acids through electrostatic interactions. When the external acidic buffer is exchanged for a more neutral buffer (e.g. pH 7.5) the surface of the lipid particle or liposome is neutralized, allowing any external nucleic acid to be removed. More detailed information on the formulation process is provided in various publications (e.g., U.S. Pat. No. 6,287,591 and U.S. Pat. No. 6,858,225).

In view of the above, the present invention provides methods of preparing lipid/nucleic acid formulations. In the methods described herein, a mixture of lipids is combined with a buffered aqueous solution of nucleic acid to produce an intermediate mixture containing nucleic acid encapsulated in lipid particles, e.g., wherein the encapsulated nucleic acids are present in a nucleic acid/lipid ratio of about 10 wt % to about 20 wt %. The intermediate mixture may optionally be sized to obtain lipid-encapsulated nucleic acid particles wherein the lipid portions are unilamellar vesicles, preferably having a diameter of 30 to 150 nm, more preferably about 40 to 90 nm. The pH is then raised to neutralize at least a portion of the surface charges on the lipid-nucleic acid particles, thus providing an at least partially surface-neutralized lipid-encapsulated nucleic acid composition.

In certain embodiments, the mixture of lipids includes at least two lipid components: a first amino lipid component of the present invention that is selected from among lipids which have a pKa such that the lipid is cationic at pH below the pKa and neutral at pH above the pKa, and a second lipid component that is selected from among lipids that prevent particle aggregation during lipid-nucleic acid particle formation. In particular embodiments, the amino lipid is a novel cationic lipid of the present invention.

In preparing the nucleic acid-lipid particles of the invention, the mixture of lipids is typically a solution of lipids in an organic solvent. This mixture of lipids can then be dried to form a thin film or lyophilized to form a powder before being hydrated with an aqueous buffer to form liposomes. Alternatively, in a preferred method, the lipid mixture can be solubilized in a water miscible alcohol, such as ethanol, and this ethanolic solution added to an aqueous buffer resulting in spontaneous liposome formation. In most embodiments, the alcohol is used in the form in which it is commercially available. For example, ethanol can be used as absolute ethanol (100%), or as 95% ethanol, the remainder being water. This method is described in more detail in U.S. Pat. No. 5,976,567).

In accordance with the invention, the lipid mixture is combined with a buffered aqueous solution that may contain the nucleic acids. The buffered aqueous solution of is typically a solution in which the buffer has a pH of less than the $pK_a$ of the protonatable lipid in the lipid mixture. Examples of suitable buffers include citrate, phosphate, acetate, and MES. A particularly preferred buffer is citrate buffer. Preferred buffers will be in the range of 1-1000 mM of the anion, depending on the chemistry of the nucleic acid being encapsulated, and optimization of buffer concentration may be significant to achieving high loading levels (see, e.g., U.S. Pat. No. 6,287,591 and U.S. Pat. No. 6,858,225). Alternatively, pure water acidified to pH 5-6 with chloride, sulfate or the like may be useful. In this case, it may be suitable to add 5% glucose, or another non-ionic solute which will balance the osmotic potential across the particle membrane when the particles are dialyzed to remove ethanol, increase the pH, or mixed with a pharmaceutically acceptable carrier such as normal saline. The amount of nucleic acid in buffer can vary, but will typically be from about 0.01 mg/mL to about 200 mg/mL, more preferably from about 0.5 mg/mL to about 50 mg/mL.

The mixture of lipids and the buffered aqueous solution of therapeutic nucleic acids is combined to provide an intermediate mixture. The intermediate mixture is typically a mixture of lipid particles having encapsulated nucleic acids. Additionally, the intermediate mixture may also contain some portion of nucleic acids which are attached to the surface of the lipid particles (liposomes or lipid vesicles) due to the ionic attraction of the negatively-charged nucleic acids and positively-charged lipids on the lipid particle surface (the amino lipids or other lipid making up the protonatable first lipid component are positively charged in a buffer having a pH of less than the $pK_a$ of the protonatable group on the lipid). In one group of preferred embodiments, the mixture of lipids is an alcohol solution of lipids and the volumes of each of the solutions are adjusted so that upon combination, the resulting alcohol content is from about 20% by volume to about 45% by volume. The method of combining the mixtures can include any of a variety of processes, often depending upon the scale of formulation produced. For example, when the total volume is about 10-20 mL or less, the solutions can be combined in a test tube and stirred together using a vortex mixer. Large-scale processes can be carried out in suitable production scale glassware.

Optionally, the lipid-encapsulated therapeutic agent (e.g., nucleic acid) complexes which are produced by combining the lipid mixture and the buffered aqueous solution of therapeutic agents (nucleic acids) can be sized to achieve a desired size range and relatively narrow distribution of lipid particle sizes. Preferably, the compositions provided herein will be sized to a mean diameter of from about 70 to about 200 nm, more preferably about 90 to about 130 nm. Several techniques are available for sizing liposomes to a desired size. One sizing method is described in U.S. Pat. No. 4,737,323, incorporated herein by reference. Sonicating a liposome suspension either by bath or probe sonication produces a progressive size reduction down to small unilamellar vesicles (SUVs) less than about 0.05 microns in size. Homogenization is another method which relies on shearing energy to fragment large liposomes into smaller ones. In a typical homogenization procedure, multilamellar vesicles are recirculated through a standard emulsion homogenizer until selected liposome sizes, typically between about 0.1 and 0.5 microns, are observed. In both methods, the particle size distribution can be monitored by conventional laser-beam particle size determination. For certain methods herein, extrusion is used to obtain a uniform vesicle size.

Extrusion of liposome compositions through a small-pore polycarbonate membrane or an asymmetric ceramic membrane results in a relatively well-defined size distribution. Typically, the suspension is cycled through the membrane one or more times until the desired liposome complex size distribution is achieved. The liposomes may be extruded through successively smaller-pore membranes, to achieve a gradual reduction in liposome size. In some instances, the lipid-nucleic acid compositions which are formed can be used without any sizing.

In particular embodiments, methods of the present invention further comprise a step of neutralizing at least some of the surface charges on the lipid portions of the lipid-nucleic acid compositions. By at least partially neutralizing the surface charges, unencapsulated nucleic acid is freed from the lipid particle surface and can be removed from the composition using conventional techniques. Preferably, unencapsulated and surface adsorbed nucleic acids are removed from the resulting compositions through exchange of buffer solutions. For example, replacement of a citrate buffer (pH about 4.0, used for forming the compositions) with a HEPES-buffered saline (HBS pH about 7.5) solution, results in the neutralization of liposome surface and nucleic acid release from the surface. The released nucleic acid can then be removed via chromatography using standard methods, and then switched into a buffer with a pH above the pKa of the lipid used.

Optionally the lipid vesicles (i.e., lipid particles) can be formed by hydration in an aqueous buffer and sized using any of the methods described above prior to addition of the nucleic acid. As described above, the aqueous buffer should be of a pH below the pKa of the amino lipid. A solution of the nucleic acids can then be added to these sized, preformed vesicles. To allow encapsulation of nucleic acids into such "pre-formed" vesicles the mixture should contain an alcohol, such as ethanol. In the case of ethanol, it should be present at a concentration of about 20% (w/w) to about 45% (w/w). In addition, it may be necessary to warm the mixture of pre-formed vesicles and nucleic acid in the aqueous buffer-ethanol mixture to a temperature of about 25° C. to about 50° C. depending on the composition of the lipid vesicles and the nature of the nucleic acid. It will be apparent to one of ordinary skill in the art that optimization of the encapsulation process to achieve a desired level of nucleic acid in the lipid vesicles will require manipulation of variable such as ethanol concentration and temperature. Examples of suitable conditions for nucleic acid encapsulation are provided in the Examples. Once the nucleic acids are encapsulated within the preformed vesicles, the external pH can be increased to at least partially neutralize the surface charge. Unencapsulated and surface adsorbed nucleic acids can then be removed as described above.

Methods for Inhibiting Expression of the PCSK9 Gene

In yet another aspect, the invention provides a method for inhibiting the expression of the PCSK9 gene in a mammal. The method includes administering a composition of the invention to the mammal such that expression of the target PCSK9 gene is decreased for an extended duration, e.g., at least one week, two weeks, three weeks, or four weeks or longer.

For example, in certain instances, expression of the PCSK9 gene is suppressed by at least about 5%, 10%, 15%, 20%, 25%, 30%, 35%, 40%, 45%, or 50% by administration of a double-stranded oligonucleotide described herein. In some embodiments, the PCSK9 gene is suppressed by at least about 60%, 70%, or 80% by administration of the double-stranded oligonucleotide. In some embodiments, the PCSK9 gene is suppressed by at least about 85%, 90%, or 95% by administration of the double-stranded oligonucleotide. Table 1b, Table 2b, and Table 5b provide a wide range of values for inhibition of expression obtained in an in vitro assay using various PCSK9 dsRNA molecules at various concentrations.

The effect of the decreased target PCSK9 gene preferably results in a decrease in LDLc (low density lipoprotein cholesterol) levels in the blood, and more particularly in the serum, of the mammal. In some embodiments, LDLc levels are decreased by at least 10%, 15%, 20%, 25%, 30%, 40%, 50%, or 60%, or more, as compared to pretreatment levels.

The method includes administering a composition containing a dsRNA, where the dsRNA has a nucleotide sequence that is complementary to at least a part of an RNA transcript of the PCSK9 gene of the mammal to be treated. When the organism to be treated is a mammal such as a human, the composition can be administered by any means known in the art including, but not limited to oral or parenteral routes, including intravenous, intramuscular, subcutaneous, transdermal, and airway (aerosol) administration. In some embodiments, the compositions are administered by intravenous infusion or injection.

The methods and compositions described herein can be used to treat diseases and conditions that can be modulated by down regulating PCSK9 gene expression. For example, the compositions described herein can be used to treat hyperlipidemia and other forms of lipid imbalance such as hypercholesterolemia, hypertriglyceridemia and the pathological conditions associated with these disorders such as heart and circulatory diseases. In some embodiments, a patient treated with a PCSK9 dsRNA is also administered a non-dsRNA therapeutic agent, such as an agent known to treat lipid disorders.

In one aspect, the invention provides a method of inhibiting the expression of the PCSK9 gene in a subject, e.g., a human. The method includes administering a first single dose of dsRNA, e.g., a dose sufficient to depress levels of PCSK9 mRNA for at least 5, more preferably 7, 10, 14, 21, 25, 30 or 40 days; and optionally, administering a second single dose of dsRNA, wherein the second single dose is administered at least 5, more preferably 7, 10, 14, 21, 25, 30 or 40 days after the first single dose is administered, thereby inhibiting the expression of the PCSK9 gene in a subject.

In one embodiment, doses of dsRNA are administered not more than once every four weeks, not more than once every three weeks, not more than once every two weeks, or not more than once every week. In another embodiment, the administrations can be maintained for one, two, three, or six months, or one year or longer.

In another embodiment, administration can be provided when Low Density Lipoprotein cholesterol (LDLc) levels reach or surpass a predetermined minimal level, such as greater than 70 mg/dL, 130 mg/dL, 150 mg/dL, 200 mg/dL, 300 mg/dL, or 400 mg/dL.

In one embodiment, the subject is selected, at least in part, on the basis of needing (as opposed to merely selecting a patient on the grounds of who happens to be in need of) LDL lowering, LDL lowering without lowering of HDL, ApoB lowering, or total cholesterol lowering without HDL lowering.

In one embodiment, the dsRNA does not activate the immune system, e.g., it does not increase cytokine levels, such as TNF-alpha or IFN-alpha levels. For example, when measured by an assay, such as an in vitro PBMC assay, such as described herein, the increase in levels of TNF-alpha or IFN-alpha, is less than 30%, 20%, or 10% of control cells treated with a control dsRNA, such as a dsRNA that does not target PCSK9.

In one aspect, the invention provides a method for treating, preventing or managing a disorder, pathological process or symptom, which, for example, can be mediated by down regulating PCSK9 gene expression in a subject, such as a human subject. In one embodiment, the disorder is hyperlipidemia. The method includes administering a first single dose of dsRNA, e.g., a dose sufficient to depress levels of PCSK9 mRNA for at least 5, more preferably 7, 10, 14, 21, 25, 30 or 40 days; and optionally, administering a second single dose of dsRNA, wherein the second single dose is administered at least 5, more preferably 7, 10, 14, 21, 25, 30 or 40 days after the first single dose is administered, thereby inhibiting the expression of the PCSK9 gene in a subject.

In another embodiment, a composition containing a dsRNA featured in the invention, i.e., a dsRNA targeting PCSK9, is administered with a non-dsRNA therapeutic agent, such as an agent known to treat a lipid disorders, such as hypercholesterolemia, atherosclerosis or dyslipidemia. For example, a dsRNA featured in the invention can be administered with, e.g., an HMG-CoA reductase inhibitor (e.g., a statin), a fibrate, a bile acid sequestrant, niacin, an antiplatelet agent, an angiotensin converting enzyme inhibitor, an angiotensin II receptor antagonist (e.g., losartan potassium, such as Merck & Co.'s Cozaar®), an acylCoA cholesterol acetyltransferase (ACAT) inhibitor, a cholesterol absorption inhibitor, a cholesterol ester transfer protein (CETP) inhibitor, a microsomal triglyceride transfer protein (MTTP) inhibitor, a cholesterol modulator, a bile acid modulator, a peroxisome proliferation activated receptor (PPAR) agonist, a gene-based therapy, a composite vascular protectant (e.g., AGI-1067, from Atherogenics), a glycoprotein IIb/IIIa inhibitor, aspirin or an aspirin-like compound, an IBAT inhibitor (e.g., S-8921, from Shionogi), a squalene synthase inhibitor, or a monocyte chemoattractant protein (MCP)-I inhibitor. Exemplary HMG-CoA reductase inhibitors include atorvastatin (Pfizer's Lipitor®/Tahor/Sortis/Torvast/Cardyl), pravastatin (Bristol-Myers Squibb's Pravachol, Sankyo's Mevalotin/Sanaprav), simvastatin (Merck's Zocor®/Sinvacor, Boehringer Ingelheim's Denan, Banyu's Lipovas), lovastatin (Merck's Mevacor/Mevinacor, Bexal's Lovastatina, Cepa; Schwarz Pharma's Liposcler), fluvastatin (Novartis' Lescol®/Locol/Lochol, Fujisawa's Cranoc, Solvay's Digaril), cerivastatin (Bayer's Lipobay/GlaxoSmithKline's Baycol), rosuvastatin (AstraZeneca's Crestor®), and pitivastatin (itavastatin/risivastatin) (Nissan Chemical, Kowa Kogyo, Sankyo, and Novartis). Exemplary fibrates include, e.g., bezafibrate (e.g., Roche's Befiza®/Cedur®/Bezalip®, Kissei's Bezatol), clofibrate (e.g., Wyeth's Atromid-S®), fenofibrate (e.g., Fournier's Lipidil/Lipantil, Abbott's Tricor®, Takeda's Lipantil, generics), gemfibrozil (e.g., Pfizer's Lopid/Lipur) and ciprofibrate (Sanofi-Synthelabo's Modalim®). Exemplary bile acid sequestrants include, e.g., cholestyramine (Bristol-Myers Squibb's Questran® and Questran Light™), colestipol (e.g., Pharmacia's Colestid), and colesevelam (Genzyme/Sankyo's WelChol™). Exemplary niacin therapies include, e.g., immediate release formulations, such as Aventis' Nicobid, Upsher-Smith's Niacor, Aventis' Nicolar, and Sanwakagaku's Perycit. Niacin extended release formulations include, e.g., Kos Pharmaceuticals' Niaspan and Upsher-Smith's SIo-Niacin. Exemplary antiplatelet agents include, e.g., aspirin (e.g., Bayer's aspirin), clopidogrel (Sanofi-Synthelabo/Bristol-Myers Squibb's Plavix), and ticlopidine (e.g., Sanofi-Synthelabo's Ticlid and Daiichi's Panaldine). Other aspirin-like compounds useful in combination with a dsRNA targeting PCSK9 include, e.g., Asacard (slow-release aspirin, by Pharmacia) and Pamicogrel (Kanebo/Angelini Ricerche/CEPA). Exemplary angiotensin-converting enzyme inhibitors include, e.g., ramipril (e.g., Aventis' Altace) and enalapril (e.g., Merck & Co.'s Vasotec). Exemplary acyl CoA cholesterol acetyltransferase (ACAT) inhibitors include, e.g., avasimibe (Pfizer), eflucimibe (BioMérieux Pierre Fabre/Eli Lilly), CS-505 (Sankyo and Kyoto), and SMP-797 (Sumito). Exemplary cholesterol absorption inhibitors include, e.g., ezetimibe (Merck/Schering-Plough Pharmaceuticals Zetia®) and Pamaqueside (Pfizer). Exemplary CETP inhibitors include, e.g., Torcetrapib (also called CP-529414, Pfizer), JTT-705 (Japan Tobacco), and CETi-I (Avant Immunotherapeutics). Exemplary microsomal triglyceride transfer protein (MTTP) inhibitors include, e.g., implitapide (Bayer), R-103757 (Janssen), and CP-346086 (Pfizer). Other exemplary cholesterol modulators include, e.g., NO-1886 (Otsuka/TAP Pharmaceutical), CI-1027 (Pfizer), and WAY-135433 (Wyeth-Ayerst). Exemplary bile acid modulators include, e.g., HBS-107 (Hisamitsu/Banyu), Btg-511 (British Technology Group), BARI-1453 (Aventis), S-8921 (Shionogi), SD-5613 (Pfizer), and AZD-7806 (AstraZeneca). Exemplary peroxisome proliferation activated receptor (PPAR) agonists include, e.g., tesaglitazar (AZ-242) (AstraZeneca), Netoglitazone (MCC-555) (Mitsubishi/Johnson & Johnson), GW-409544 (Ligand Pharmaceuticals/GlaxoSmithKline), GW-501516 (Ligand Pharmaceuticals/GlaxoSmithKline), LY-929 (Ligand Pharmaceuticals and Eli Lilly), LY-465608 (Ligand Pharmaceuticals and Eli Lilly), LY-518674 (Ligand Pharmaceuticals and Eli Lilly), and MK-767 (Merck and Kyorin). Exemplary gene-based therapies include, e.g., AdGWEGF121.10 (GenVec), ApoAl (UCB Pharma/Groupe Fournier), EG-004 (Trinam) (Ark Therapeutics), and ATP-binding cassette transporter-Al (ABCAl) (CV Therapeutics/Incyte, Aventis, Xenon). Exemplary Glycoprotein IIb/IIIa inhibitors include, e.g., roxifiban (also called DMP754, Bristol-Myers Squibb), Gantofiban (Merck KGaA/Yamanouchi), and Cromafiban (Millennium Pharmaceuticals). Exemplary squalene synthase inhibitors include, e.g., BMS-1884941 (Bristol-Myers Squibb), CP-210172 (Pfizer), CP-295697 (Pfizer), CP-294838 (Pfizer), and TAK-475 (Takeda). An exemplary MCP-I inhibitor is, e.g., RS-504393 (Roche Bioscience). The anti-atherosclerotic agent BO-653 (Chugai Pharmaceuticals), and the nicotinic acid derivative Nyclin (Yamanouchi Pharmacuticals) are also appropriate for administering in combination with a dsRNA featured in the invention. Exemplary combination therapies suitable for administration with a dsRNA targeting PCSK9 include, e.g., advicor (Niacin/lovastatin from Kos Pharmaceuticals), amlodipine/atorvastatin (Pfizer), and ezetimibe/simvastatin (e.g., Vytorin® 10/10, 10/20, 10/40, and 10/80 tablets by Merck/Schering-Plough Pharmaceuticals). Agents for treating hypercholesterolemia, and suitable for administration in combination with a dsRNA targeting PCSK9 include, e.g., lovastatin, niacin Altoprev® Extended-Release Tablets (Andrx Labs), lovastatin Caduet® Tablets (Pfizer), amlodipine besylate, atorvastatin calcium Crestor® Tablets (AstraZeneca), rosuvastatin calcium Lescol® Capsules (Novartis), fluvastatin sodium Lescol® (Reliant, Novartis), fluvastatin sodium Lipitor® Tablets (Parke-Davis), atorvastatin calcium Lofibra® Capsules (Gate), Niaspan Extended-Release Tablets (Kos), niacin Pravachol Tablets (Bristol-Myers Squibb), pravastatin sodium TriCor® Tablets (Abbott), fenofibrate Vytorin® 10/10 Tablets (Merck/Schering-Plough Pharmaceuticals), ezetimibe, simvastatin WelChol™ Tablets (Sankyo), colesevelam hydrochloride Zetia® Tablets (Schering), ezetimibe Zetia® Tablets (Merck/Schering-Plough Pharmaceuticals), and ezetimibe Zocor® Tablets (Merck).

In one embodiment, a dsRNA targeting PCSK9 is administered in combination with an ezetimibe/simvastatin combination (e.g., Vytorin® (Merck/Schering-Plough Pharmaceuticals)).

In one embodiment, the PCSK9 dsRNA is administered to the patient, and then the non-dsRNA agent is administered to the patient (or vice versa). In another embodiment, the PCSK9 dsRNA and the non-dsRNA therapeutic agent are administered at the same time.

In another aspect, the invention features, a method of instructing an end user, e.g., a caregiver or a subject, on how to administer a dsRNA described herein. The method includes, optionally, providing the end user with one or more doses of the dsRNA, and instructing the end user to administer the dsRNA on a regimen described herein, thereby instructing the end user.

In yet another aspect, the invention provides a method of treating a patient by selecting a patient on the basis that the patient is in need of LDL lowering, LDL lowering without lowering of HDL, ApoB lowering, or total cholesterol lowering. The method includes administering to the patient a dsRNA targeting PCSK9 in an amount sufficient to lower the patient's LDL levels or ApoB levels, e.g., without substantially lowering HDL levels.

In another aspect, the invention provides a method of treating a patient by selecting a patient on the basis that the patient is in need of lowered ApoB levels, and administering to the patient a dsRNA targeting PCSK9 in an amount sufficient to lower the patient's ApoB levels. In one embodiment, the amount of PCSK9 is sufficient to lower LDL levels as well as ApoB levels. In another embodiment, administration of the PCSK9 dsRNA does not affect the level of HDL cholesterol in the patient.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1

Gene Walking of the PCSK9 Gene siRNA design was carried out to identify in two separate selections
a) siRNAs targeting PCSK9 human and either mouse or rat mRNA and
b) all human reactive siRNAs with predicted specificity to the target gene PCSK9.

mRNA sequences to human, mouse and rat PCSK9 were used: Human sequence NM_174936.2 was used as reference sequence during the complete siRNA selection procedure.

19 mer stretches conserved in human and mouse, and human and rat PCSK9 mRNA sequences were identified in the first step, resulting in the selection of siRNAs cross-reactive to human and mouse, and siRNAs cross-reactive to human and rat targets SiRNAs specifically targeting human PCSK9 were identified in a second selection. All potential 19mer sequences of human PCSK9 were extracted and defined as candidate target sequences. Sequences cross-reactive to human, monkey, and those cross-reactive to mouse, rat, human and monkey are all listed in Tables 1a and 2a. Chemically modified versions of those sequences and their activity in both in vitro and in vivo assays are also listed in Tables 1a and 2a. The data is described in the examples and in FIGS. 2-8.

In order to rank candidate target sequences and their corresponding siRNAs and select appropriate ones, their predicted potential for interacting with irrelevant targets (off-target potential) was taken as a ranking parameter. siRNAs with low off-target potential were defined as preferable and assumed to be more specific in vivo.

For predicting siRNA-specific off-target potential, the following assumptions were made:
1) positions 2 to 9 (counting 5' to 3') of a strand (seed region) may contribute more to off-target potential than rest of sequence (non-seed and cleavage site region)
2) positions 10 and 11 (counting 5' to 3') of a strand (cleavage site region) may contribute more to off-target potential than non-seed region
3) positions 1 and 19 of each strand are not relevant for off-target interactions
4) an off-target score can be calculated for each gene and each strand, based on complementarity of siRNA strand sequence to the gene's sequence and position of mismatches
5) number of predicted off-targets as well as highest off-target score must be considered for off-target potential
6) off-target scores are to be considered more relevant for off-target potential than numbers of off-targets 7) assuming potential abortion of sense strand activity by internal modifications introduced, only off-target potential of antisense strand will be relevant To identify potential off-target genes, 19mer candidate sequences were subjected to a homology search against publically available human mRNA sequences.

The following off-target properties for each 19mer input sequence were extracted for each off-target gene to calculate the off-target score:

Number of mismatches in non-seed region
Number of mismatches in seed region
Number of mismatches in cleavage site region The off-target score was calculated for considering assumption 1 to 3 as follows:

Off-target score=number of seed mismatches*10+ number of cleavage site mismatches*1.2+number of non-seed mismatches*1

The most relevant off-target gene for each siRNA corresponding to the input 19mer sequence was defined as the gene with the lowest off-target score. Accordingly, the lowest off-target score was defined as the relevant off-target score for each siRNA.

Example 2 dsRNA Synthesis

Source of Reagents

Where the source of a reagent is not specifically given herein, such reagent may be obtained from any supplier of reagents for molecular biology at a quality/purity standard for application in molecular biology.

siRNA Synthesis

Single-stranded RNAs were produced by solid phase synthesis on a scale of 1 μmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

Conjugated siRNAs

For the synthesis of 3'-cholesterol-conjugated siRNAs (herein referred to as -Chol-3), an appropriately modified solid support was used for RNA synthesis. The modified solid support was prepared as follows:

Diethyl-2-azabutane-1,4-dicarboxylate AA

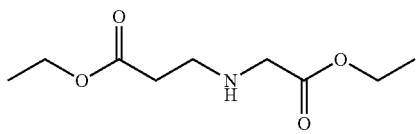

AA

A 4.7 M aqueous solution of sodium hydroxide (50 ml) was added into a stirred, ice-cooled solution of ethyl glycinate hydrochloride (32.19 g, 0.23 mole) in water (50 ml). Then, ethyl acrylate (23.1 g, 0.23 mole) was added and the mixture was stirred at room temperature until completion of the reaction was ascertained by TLC. After 19 h the solution was partitioned with dichloromethane (3×100 ml). The organic layer was dried with anhydrous sodium sulfate, filtered and evaporated. The residue was distilled to afford AA (28.8 g, 61%).

3-{Ethoxycarbonylmethyl-[6-(9H-fluoren-9-ylmethoxy-carbonyl-amino)-hexanoyl]-amino}-propionic acid ethyl ester AB

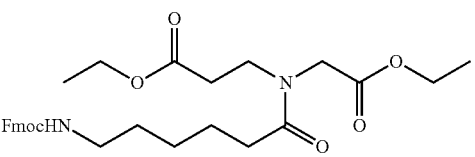

AB

Fmoc-6-amino-hexanoic acid (9.12 g, 25.83 mmol) was dissolved in dichloromethane (50 ml) and cooled with ice. Diisopropylcarbodiimde (3.25 g, 3.99 ml, 25.83 mmol) was added to the solution at 0° C. It was then followed by the addition of Diethyl-azabutane-1,4-dicarboxylate (5 g, 24.6 mmol) and dimethylamino pyridine (0.305 g, 2.5 mmol). The solution was brought to room temperature and stirred further for 6 h. Completion of the reaction was ascertained by TLC. The reaction mixture was concentrated under vacuum and ethyl acetate was added to precipitate diisopropyl urea. The suspension was filtered. The filtrate was washed with 5% aqueous hydrochloric acid, 5% sodium bicarbonate and water. The combined organic layer was dried over sodium sulfate and concentrated to give the crude product which was purified by column chromatography (50% EtOAC/Hexanes) to yield 11.87 g (88%) of AB.

3-[(6-Amino-hexanoyl)-ethoxycarbonylmethyl-amino]-propionic acid ethyl ester AC

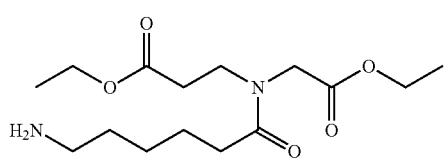

AC

3-{Ethoxycarbonylmethyl-[6-(9H-fluoren-9-ylmethoxy-carbonylamino)-hexanoyl]-amino}-propionic acid ethyl ester AB (11.5 g, 21.3 mmol) was dissolved in 20% piperidine in dimethylformamide at 0° C. The solution was continued stirring for 1 h. The reaction mixture was concentrated under vacuum, water was added to the residue, and the product was extracted with ethyl acetate. The crude product was purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic acid ethyl ester AD Potassium t-butoxide (1.1 g, 9.8 mmol) was slurried in 30 ml of dry toluene. The mixture was cooled to 0° C. on ice and 5 g (6.6 mmol) of diester AD was added slowly with stirring within 20 mins. The temperature was kept below 5° C. during the addition. The stirring was continued for 30 mins at 0° C. and 1 ml of glacial acetic acid was added, immediately followed by 4 g of $NaH_2PO_4.H_2O$ in 40 ml of water The resultant mixture was extracted twice with 100 ml of dichloromethane each and the combined organic extracts were washed twice with 10 ml of phosphate buffer each, dried, and evaporated to

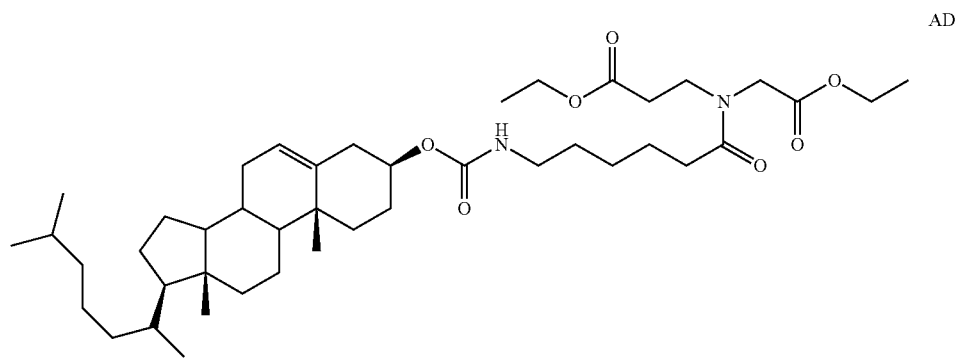

AD

The hydrochloride salt of 3-[(6-Amino-hexanoyl)-ethoxycarbonylmethyl-amino]-propionic acid ethyl ester AC (4.7 g, 14.8 mmol) was taken up in dichloromethane. The suspension was cooled to 0° C. on ice. To the suspension diisopropyl-ethylamine (3.87 g, 5.2 ml, 30 mmol) was added. To the resulting solution cholesteryl chloroformate (6.675 g, 14.8 mmol) was added. The reaction mixture was stirred overnight. The reaction mixture was diluted with dichloromethane and washed with 10% hydrochloric acid. The product was purified by flash chromatography (10.3 g, 92%).

1-{6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}-4-oxo-pyrrolidine-3-carboxylic acid ethyl ester AE dryness. The residue was dissolved in 60 ml of toluene, cooled to 0° C. and extracted with three 50 ml portions of cold pH 9.5 carbonate buffer. The aqueous extracts were adjusted to pH 3 with phosphoric acid, and extracted with five 40 ml portions of chloroform which were combined, dried and evaporated to dryness. The residue was purified by column chromatography using 25% ethylacetate/hexane to afford 1.9 g of b-ketoester (39%)

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AF

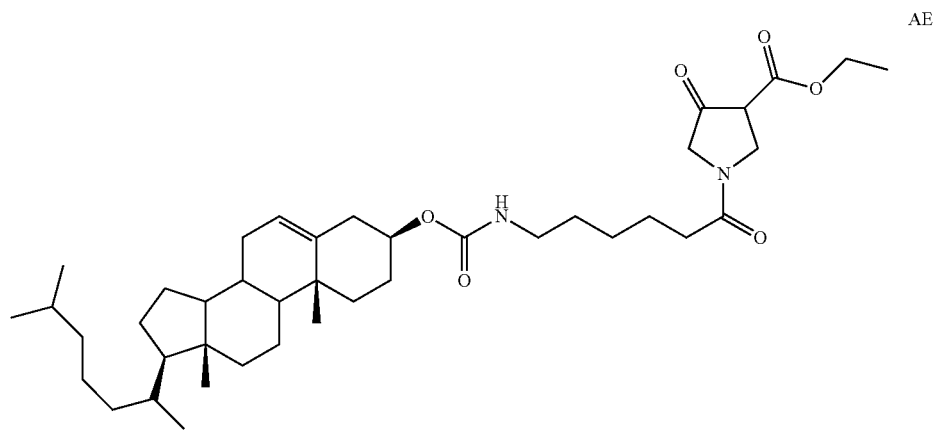

AE

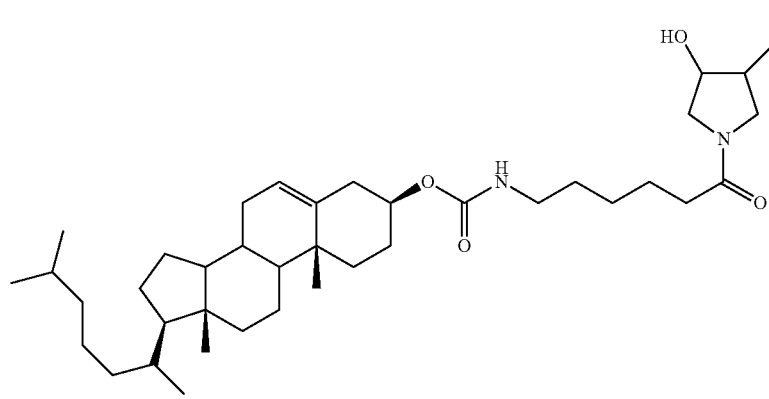

Methanol (2 ml) was added dropwise over a period of 1 h to a refluxing mixture of b-ketoester AE (1.5 g, 2.2 mmol) and sodium borohydride (0.226 g, 6 mmol) in tetrahydrofuran (10 ml). Stirring was continued at reflux temperature for 1 h. After cooling to room temperature, 1 N HCl (12.5 ml) was added, the mixture was extracted with ethylacetate (3×40 ml). The combined ethylacetate layer was dried over anhydrous sodium sulfate and concentrated under vacuum to yield the product which was purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AG Diol AF (1.25 gm 1.994 mmol) was dried by evaporating with pyridine (2×5 ml) in vacuo. Anhydrous pyridine (10 ml) and 4,4'-dimethoxytritylchloride (0.724 g, 2.13 mmol) were added with stirring. The reaction was carried out at room temperature overnight. The reaction was quenched by the addition of methanol. The reaction mixture was concentrated under vacuum and to the residue dichloromethane (50 ml) was added. The organic layer was washed with 1M aqueous sodium bicarbonate. The organic layer was dried over anhydrous sodium sulfate, filtered and concentrated. The residual pyridine was removed by evaporating with toluene. The crude product was purified by column chromatography (2% MeOH/Chloroform, Rf=0.5 in 5% MeOH/CHCl$_3$) (1.75 g, 95%).

Succinic acid mono-(4-[bis-(4-methoxy-phenyl)-phenyl-methoxymethyl]-1-{6-[17-(1,5-dimethyl-hexyl)-10,13-dimethyl 2,3,4,7,8,9,10,11,12,13,14,15,16,17-tetradecahydro-1H cyclopenta[a]phenanthren-3-yloxycarbonylamino]-hexanoyl}-pyrrolidin-3-yl) ester AH

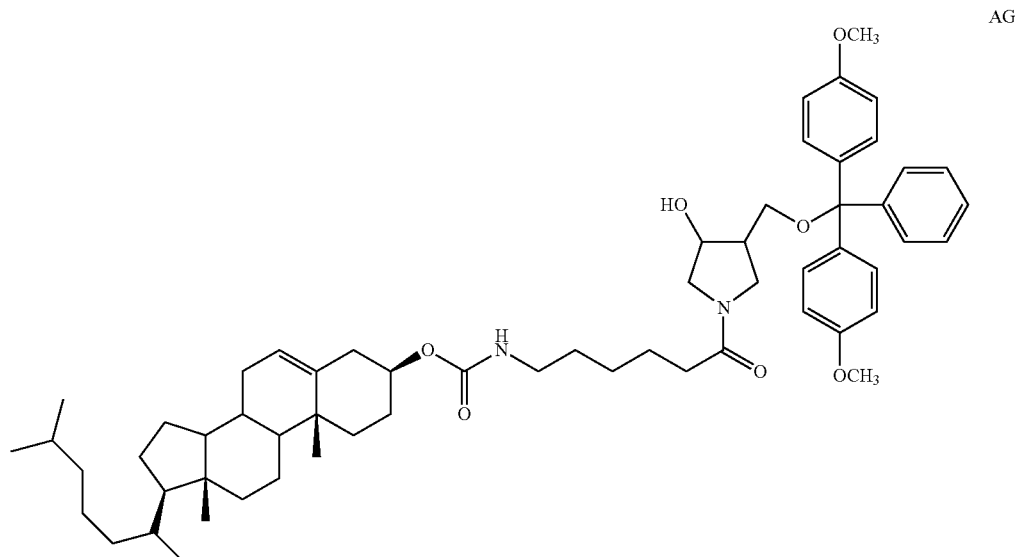

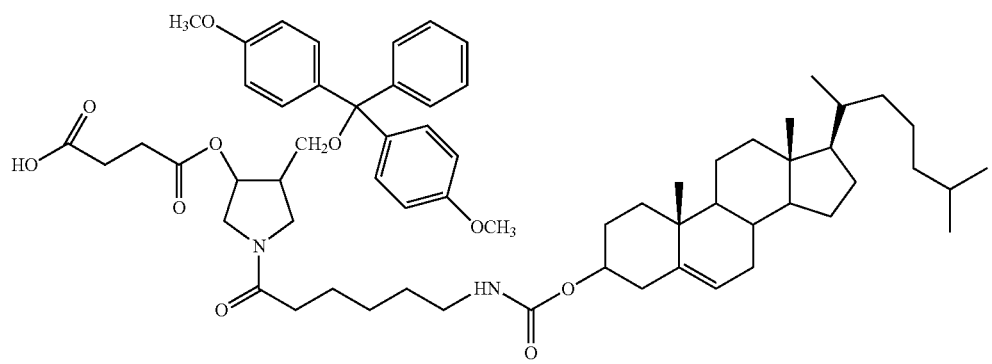

AH

Compound AG (1.0 g, 1.05 mmol) was mixed with succinic anhydride (0.150 g, 1.5 mmol) and DMAP (0.073 g, 0.6 mmol) and dried in a vacuum at 40° C. overnight. The mixture was dissolved in anhydrous dichloroethane (3 ml), triethylamine (0.318 g, 0.440 ml, 3.15 mmol) was added and the solution was stirred at room temperature under argon atmosphere for 16 h. It was then diluted with dichloromethane (40 ml) and washed with ice cold aqueous citric acid (5 wt %, 30 ml) and water (2×20 ml). The organic phase was dried over anhydrous sodium sulfate and concentrated to dryness. The residue was used as such for the next step.

Cholesterol Derivatised CPG AI

Chol-") was performed as described in WO 2004/065601, except that, for the cholesteryl derivative, the oxidation step was performed using the Beaucage reagent in order to introduce a phosphorothioate linkage at the 5'-end of the nucleic acid oligomer.

Figure 16:
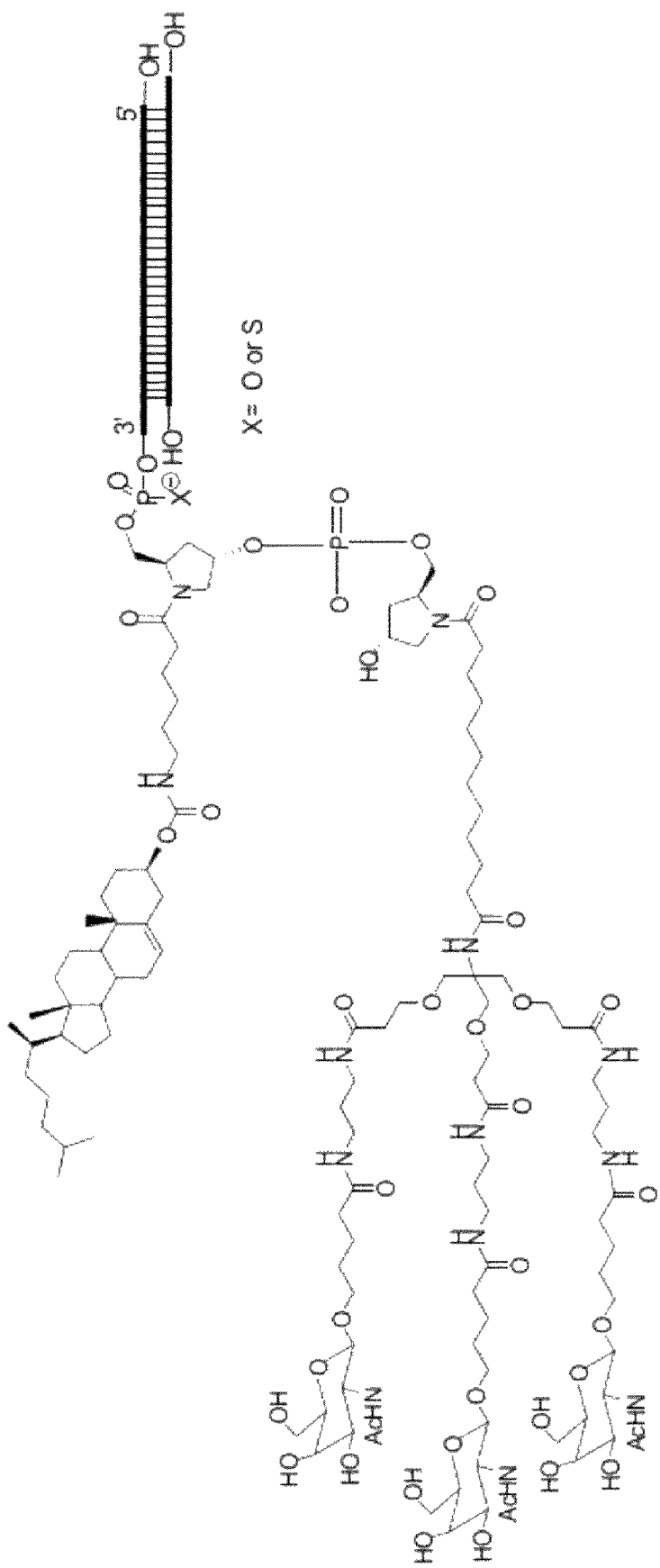
FIG. 16 shows the structure of an siRNA conjugated to Chol-p-(GalNAc)3 via phosphate linkage at the 3' end.

Synthesis of dsRNAs conjugated to Chol-p-(GalNAc)$_3$ (N-acetyl galactosamine-cholesterol) (FIG. 16) and LCO (GalNAc)$_3$ (N-acetyl galactosamine-3'-Lithocholic-oleoyl) (FIG. 17) is described in U.S. patent application Ser. No. 12/328,528, filed on Dec. 4, 2008, which is hereby incorporated by reference.

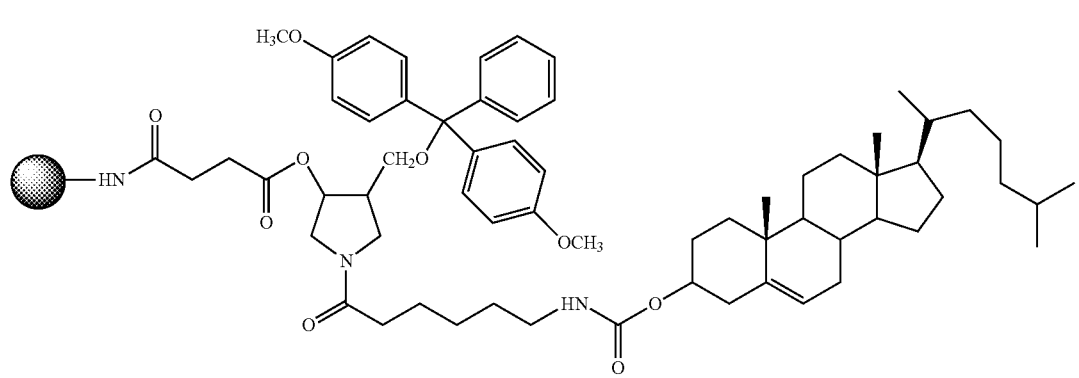

AI

Succinate AH (0.254 g, 0.242 mmol) was dissolved in a mixture of dichloromethane/acetonitrile (3:2, 3 ml). To that solution DMAP (0.0296 g, 0.242 mmol) in acetonitrile (1.25 ml), 2,2'-Dithio-bis(5-nitropyridine) (0.075 g, 0.242 mmol) in acetonitrile/dichloroethane (3:1, 1.25 ml) were added successively. To the resulting solution triphenylphosphine (0.064 g, 0.242 mmol) in acetonitrile (0.6 ml) was added. The reaction mixture turned bright orange in color. The solution was agitated briefly using a wrist-action shaker (5 mins). Long chain alkyl amine-CPG (LCAA-CPG) (1.5 g, 61 mM) was added. The suspension was agitated for 2 h. The CPG was filtered through a sintered funnel and washed with acetonitrile, dichloromethane and ether successively. Unreacted amino groups were masked using acetic anhydride/pyridine. The achieved loading of the CPG was measured by taking UV measurement (37 mM/g).

The synthesis of siRNAs bearing a 5'-12-dodecanoic acid bisdecylamide group (herein referred to as "5'-C32-") or a 5'-cholesteryl derivative group (herein referred to as "5'-

Example 3

PCSK9 siRNA Screening in HuH7, HepG2, HeLa and Primary Monkey Hepatocytes Discovers Highly Active Sequences HuH-7cells were obtained from JCRB Cell Bank (Japanese Collection of Research Bioresources) (Shinjuku, Japan, cat. No.: JCRB0403) Cells were cultured in Dulbecco's MEM (Biochrom AG, Berlin, Germany, cat. No. F0435) supplemented to contain 10% fetal calf serum (FCS) (Biochrom AG, Berlin, Germany, cat. No. S0115), Penicillin 100 U/ml, Streptomycin 100 µg/ml (Biochrom AG, Berlin, Germany, cat. No. A2213) and 2 mM L-Glutamin (Biochrom AG, Berlin, Germany, cat. No K0282) at 37° C. in an atmosphere with 5% CO$_2$ in a humidified incubator (Heraeus HERAcell, Kendro Laboratory Products, Langenselbold, Germany). HepG2 and HeLa cells were obtained from American Type Culture Collection (Rockville, Md., cat. No. HB-8065) and cultured in MEM (Gibco Invitrogen, Karlsruhe, Germany, cat. No. 21090-022) supplemented to contain 10% fetal calf serum (FCS) (Biochrom AG, Berlin, Germany, cat. No. S0115), Penicillin 100 U/ml, Streptomycin 100 µg/ml (Biochrom AG, Berlin, Germany, cat. No. A2213), 1×Non Essential Amino Acids (Biochrom AG, Berlin, Germany, cat. No. K-0293), and 1 mM Sodium Pyruvate (Biochrom AG, Berlin, Germany, cat. No. L-0473) at 37° C. in an atmosphere with 5% $CO_2$ in a humidified incubator (Heraeus HERAcell, Kendro Laboratory Products, Langenselbold, Germany).

For transfection with siRNA, HuH7, HepG2, or HeLa cells were seeded at a density of $2.0\times10^4$ cells/well in 96-well plates and transfected directly. Transfection of siRNA (30 nM for single dose screen) was carried out with lipofectamine 2000 (Invitrogen GmbH, Karlsruhe, Germany, cat. No. 11668-019) as described by the manufacturer.

24 hours after transfection HuH7 and HepG2 cells were lysed and PCSK9 mRNA levels were quantified with the Quantigene Explore Kit (Genosprectra, Dumbarton Circle Fremont, USA, cat. No. QG-000-02) according to the protocol. PCSK9 mRNA levels were normalized to GAP-DH mRNA. For each siRNA eight individual datapoints were collected. siRNA duplexes unrelated to PCSK9 gene were used as control. The activity of a given PCSK9 specific siRNA duplex was expressed as percent PCSK9 mRNA concentration in treated cells relative to PCSK9 mRNA concentration in cells treated with the control siRNA duplex.

Primary cynomolgus monkey hepatocytes (cryopreserved) were obtained from In vitro Technologies, Inc. (Baltimore, Md., USA, cat No M00305) and cultured in InVitroGRO CP Medium (cat No Z99029) at 37° C. in an atmosphere with 5% $CO_2$ in a humidified incubator.

For transfection with siRNA, primary cynomolgus monkey cells were seeded on Collagen coated plates (Fisher Scientific, cat. No. 08-774-5) at a density of $3.5\times10^4$ cells/well in 96-well plates and transfected directly. Transfection of siRNA (eight 2-fold dilution series starting from 30 nM) in duplicates was carried out with lipofectamine 2000 (Invitrogen GmbH, Karlsruhe, Germany, cat. No. 11668-019) as described by the manufacturer.

16 hours after transfection medium was changed to fresh InVitroGRO CP Medium with Torpedo Antibiotic Mix (In vitro Technologies, Inc, cat. No Z99000) added.

24 hours after medium change primary cynomolgus monkey cells were lysed and PCSK9 mRNA levels were quantified with the Quantigene Explore Kit (Genosprectra, Dumbarton Circle Fremont, USA, cat. No. QG-000-02) according to the protocol. PCSK9 mRNA levels were normalized to GAPDH mRNA. Normalized PCSK9/GAPDH ratios were then compared to PCSK9/GAPDH ratio of lipofectamine 2000 only control.

Tables 1b and 2b (and FIG. 6A) summarize the results and provide examples of in vitro screens in different cell lines at different doses. Silencing of PCSK9 transcript was expressed as percentage of remaining transcript at a given dose.

Highly active sequences are those with less than 70% transcript remaining post treatment with a given siRNA at a dose less than or equal to 100 nM. Very active sequences are those that have less than 60% of transcript remaining after treatment with a dose less than or equal to 100 nM. Active sequences are those that have less than 90% transcript remaining after treatment with a high dose (100 nM).

Examples of active siRNAs were also screened in vivo in mouse in lipidoid formulations as described below. Active sequences in vitro were also generally active in vivo (See FIGS. 6A and 6B and example 4).

Example 4

In Vivo Efficacy Screen of PCSK9 siRNAs in Mice

32 PCSK9 siRNAs formulated in LNP-01 liposomes were tested in vivo in a mouse model. LNP01 is a lipidoid formulation formed from cholesterol, mPEG2000-C14 Glyceride, and dsRNA. The LNP01 formulation is useful for delivering dsRNAs to the liver.

Formulation Procedure

The lipidoid LNP-01.4HCl (MW 1487) (FIG. 1), Cholesterol (Sigma-Aldrich), and PEG-Ceramide C16 (Avanti Polar Lipids) were used to prepare lipid-siRNA nanoparticles. Stock solutions of each in ethanol were prepared: LNP-01, 133 mg/ml; Cholesterol, 25 mg/ml, PEG-Ceramide C16, 100 mg/ml. LNP-01, Cholesterol, and PEG-Ceramide C16 stock solutions were then combined in a 42:48:10 molar ratio. Combined lipid solution was mixed rapidly with aqueous siRNA (in sodium acetate pH 5) such that the final ethanol concentration was 35-45% and the final sodium acetate concentration was 100-300 mM. Lipid-siRNA nanoparticles formed spontaneously upon mixing. Depending on the desired particle size distribution, the resultant nanoparticle mixture was in some cases extruded through a polycarbonate membrane (100 nm cut-off) using a thermobarrel extruder (Lipex Extruder, Northern Lipids, Inc). In other cases, the extrusion step was omitted. Ethanol removal and simultaneous buffer exchange was accomplished by either dialysis or tangential flow filtration. Buffer was exchanged to phosphate buffered saline (PBS) pH 7.2.

Characterization of Formulations

Formulations prepared by either the standard or extrusion-free method are characterized in a similar manner. Formulations are first characterized by visual inspection. They should be whitish translucent solutions free from aggregates or sediment. Particle size and particle size distribution of lipid-nanoparticles are measured by dynamic light scattering using a Malvern Zetasizer Nano ZS (Malvern, USA). Particles should be 20-300 nm, and ideally, 40-100 nm in size. The particle size distribution should be unimodal. The total siRNA concentration in the formulation, as well as the entrapped fraction, is estimated using a dye exclusion assay. A sample of the formulated siRNA is incubated with the RNA-binding dye Ribogreen (Molecular Probes) in the presence or absence of a formulation disrupting surfactant, 0.5% Triton-X100. The total siRNA in the formulation is determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%.

Bolus Dosing

Bolus dosing of formulated siRNAs in C57/BL6 mice (5/group, 8-10 weeks old, Charles River Laboratories, MA) was performed by tail vein injection using a 27G needle. SiRNAs were formulated in LNP-01 (and then dialyzed against PBS) at 0.5 mg/ml concentration allowing the delivery of the 5 mg/kg dose in 10 µl/g body weight. Mice were kept under an infrared lamp for approximately 3 min prior to dosing to ease injection.

48 hour post dosing mice were sacrificed by $CO_2$-asphyxiation. 0.2 ml blood was collected by retro-orbital bleeding and the liver was harvested and frozen in liquid nitrogen. Serum and livers were stored at −80° C. µl Frozen livers were grinded using 6850 Freezer/Mill Cryogenic Grinder (SPEX CentriPrep, Inc) and powders stored at −80° C. until analysis.

PCSK9 mRNA levels were detected using the branched-DNA technology based kit from QuantiGene Reagent System (Genospectra) according to the protocol. 10-20 mg of frozen liver powders was lysed in 600 µl of 0.16 µg/ml Proteinase K (Epicentre, #MPRK092) in Tissue and Cell Lysis Solution (Epicentre, #MTC096H) at 65° C. for 3 hours. Then 10 µl of the lysates were added to 90 µl of Lysis Working Reagent (1 volume of stock Lysis Mixture in two volumes of water) and incubated at 52° C. overnight on Genospectra capture plates with probe sets specific to mouse PCSK9 and mouse GAPDH or cyclophilin B. Nucleic acid sequences for Capture Extender (CE), Label Extender (LE) and blocking (BL) probes were selected from the nucleic acid sequences of PCSK9, GAPDH and cyclophilin B with the help of the QuantiGene ProbeDesigner Software 2.0 (Genospectra, Fremont, Calif., USA, cat. No. QG-002-02). Chemo luminescence was read on a Victor2-Light (Perkin Elmer) as Relative light units. The ratio of PCSK9 mRNA to GAPDH or cyclophilin B mRNA in liver lysates was averaged over each treatment group and compared to a control group treated with PBS or a control group treated with an unrelated siRNA (blood coagulation factor VII).

Total serum cholesterol in mouse serum was measured using the StanBio Cholesterol LiquiColor kit (StanBio Laboratory, Boerne, Tex., USA) according to manufacturer's instructions. Measurements were taken on a Victor2 1420 Multilabel Counter (Perkin Elmer) at 495 nm.

Results

Figure 2:
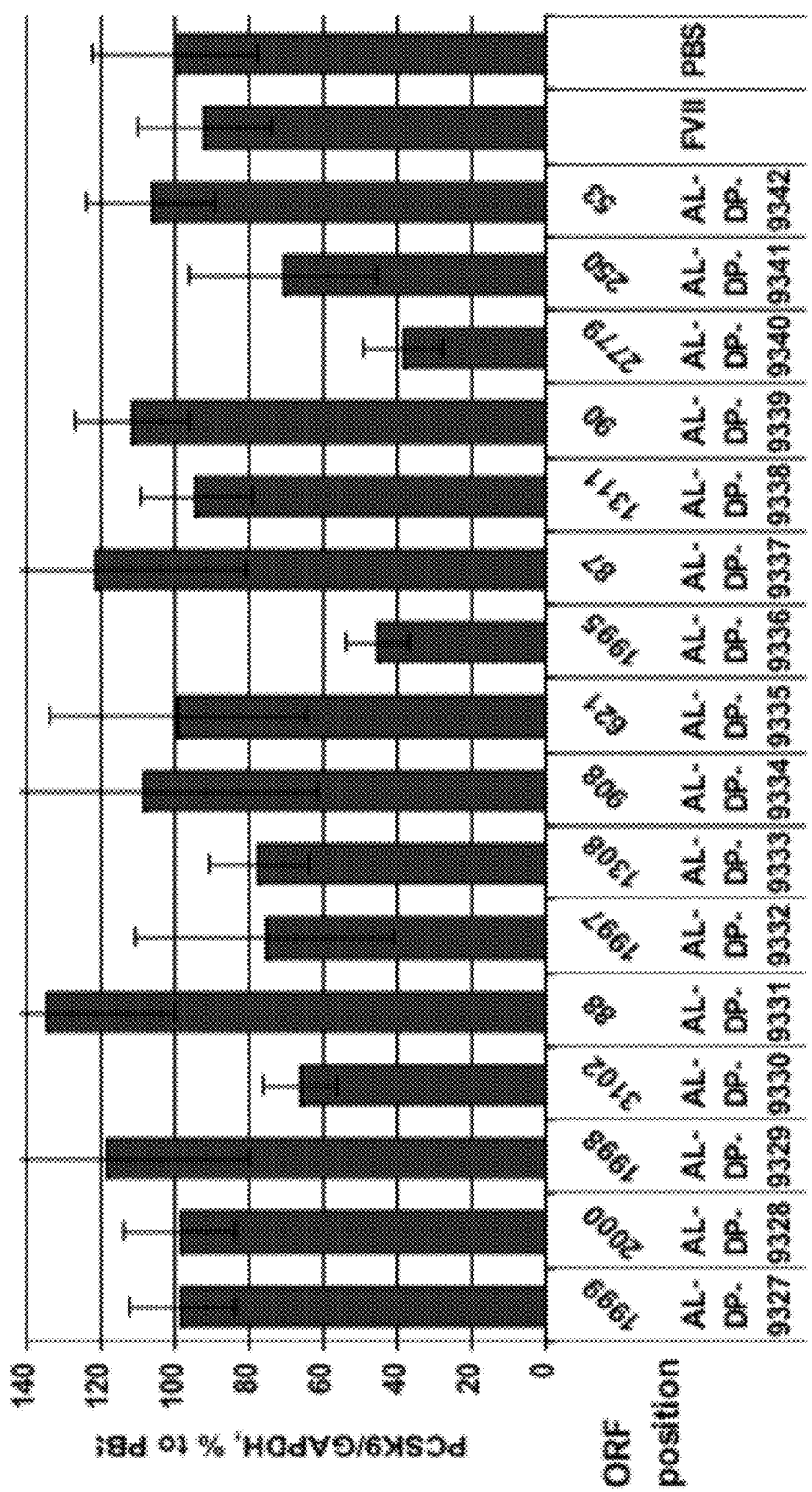
FIG. 2 shows the results of the in vivo screen of 16 mouse specific (AL-DP-9327 through AL-DP-9342) PCSK9 siRNAs directed against different ORF regions of PCSK9 mRNA (having the first nucleotide corresponding to the ORF position indicated on the graph) in C57/BL6 mice (5 animals/group). The ratio of PCSK9 mRNA to GAPDH mRNA in liver lysates was averaged over each treatment group and compared to a control group treated with PBS or a control group treated with an unrelated siRNA (blood coagulation factor VII).
Figure 3:
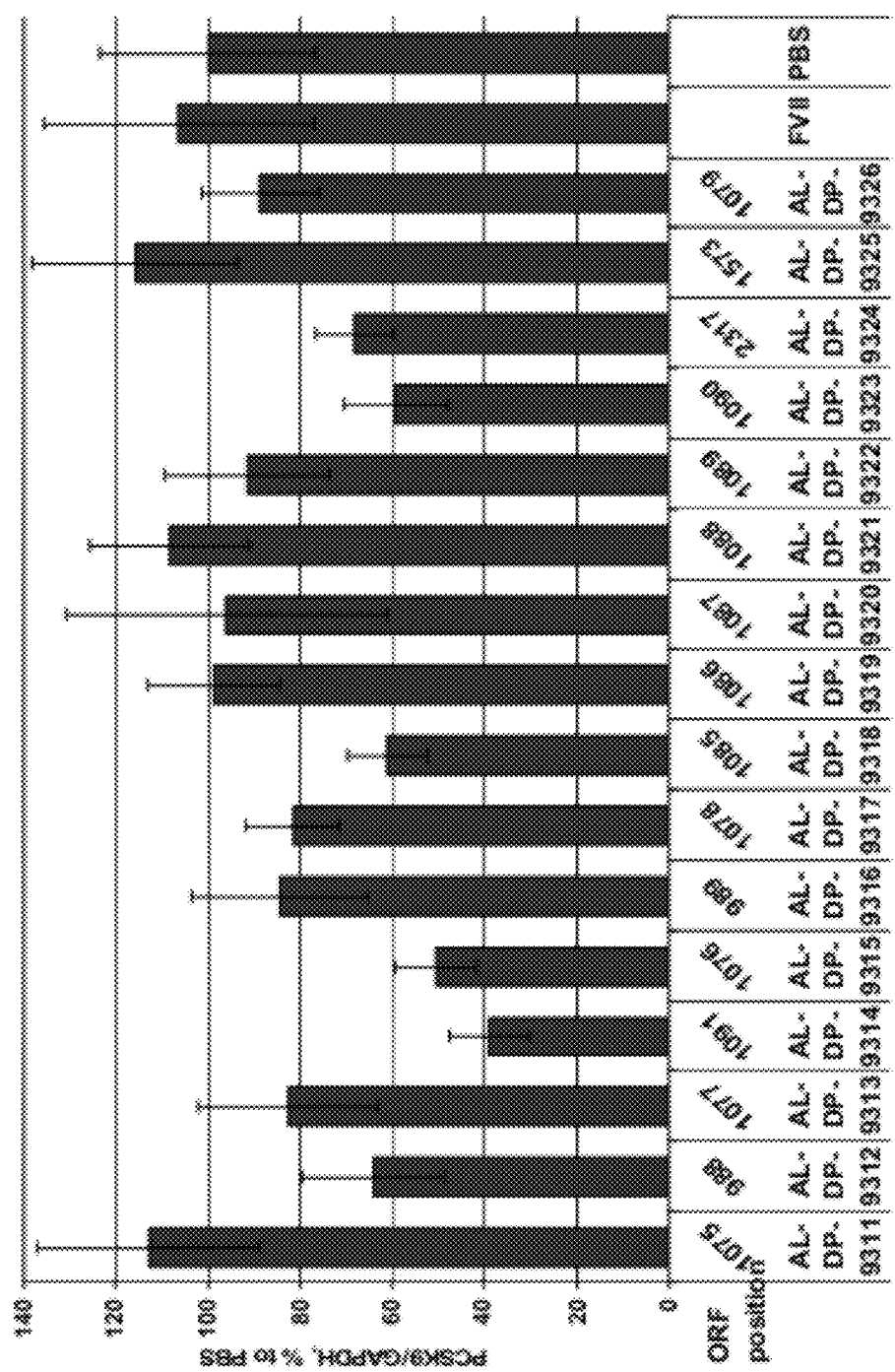
FIG. 3 shows the results of the in vivo screen of 16 human/mouse/rat cross-reactive (AL-DP-9311 through AL-DP-9326) PCSK9 siRNAs directed against different ORF regions of PCSK9 mRNA (having the first nucleotide corresponding to the ORF position indicated on the graph) in C57/BL6 mice (5 animals/group). The ratio of PCSK9 mRNA to GAPDH mRNA in liver lysates was averaged over each treatment group and compared to a control group treated with PBS or a control group treated with an unrelated siRNA (blood coagulation factor VII).
Figure 4:
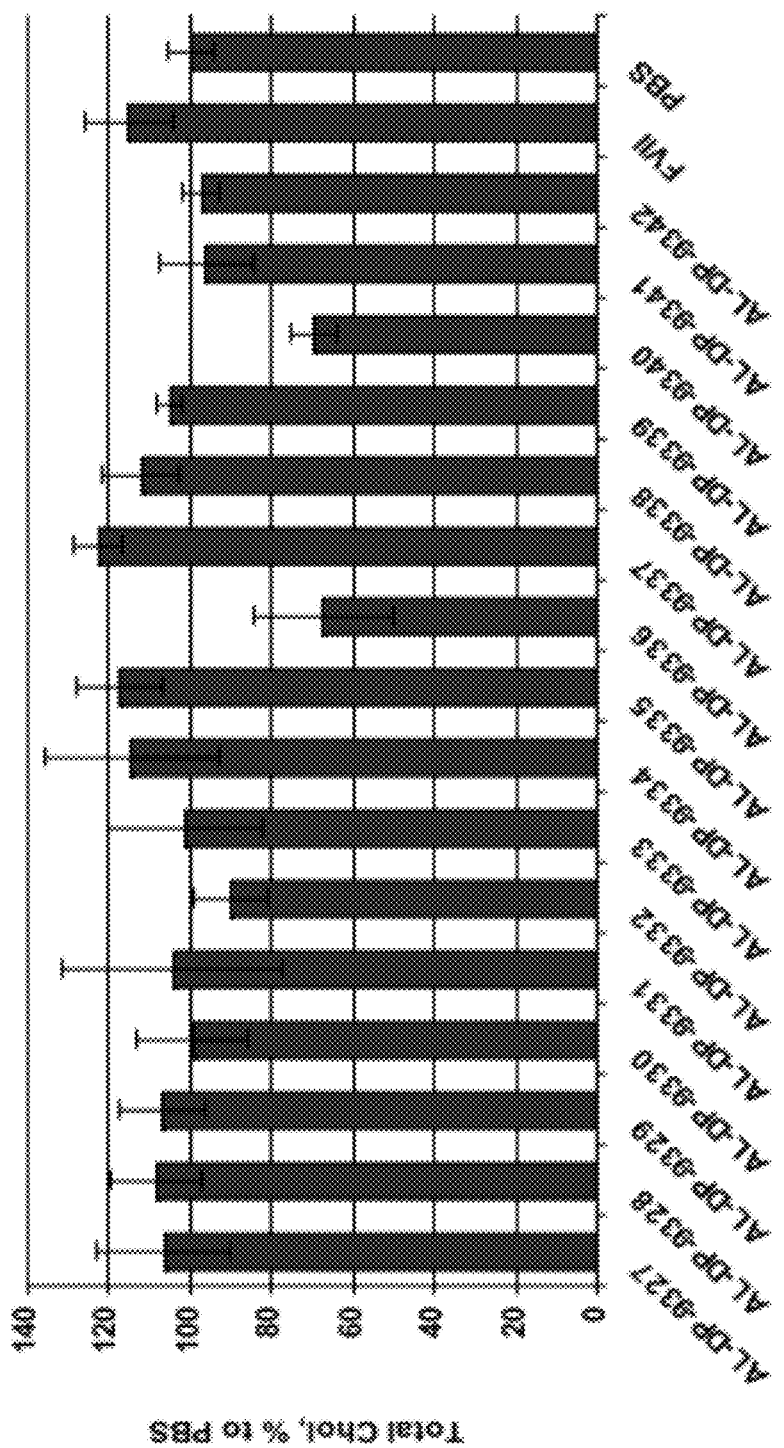
FIG. 4 shows the results of the in vivo screen of 16 mouse specific (AL-DP-9327 through AL-DP-9342) PCSK9 siRNAs in C57/BL6 mice (5 animals/group). Total serum cholesterol levels were averaged over each treatment group and compared to a control group treated with PBS or a control group treated with an unrelated siRNA (blood coagulation factor VII).
Figure 5:
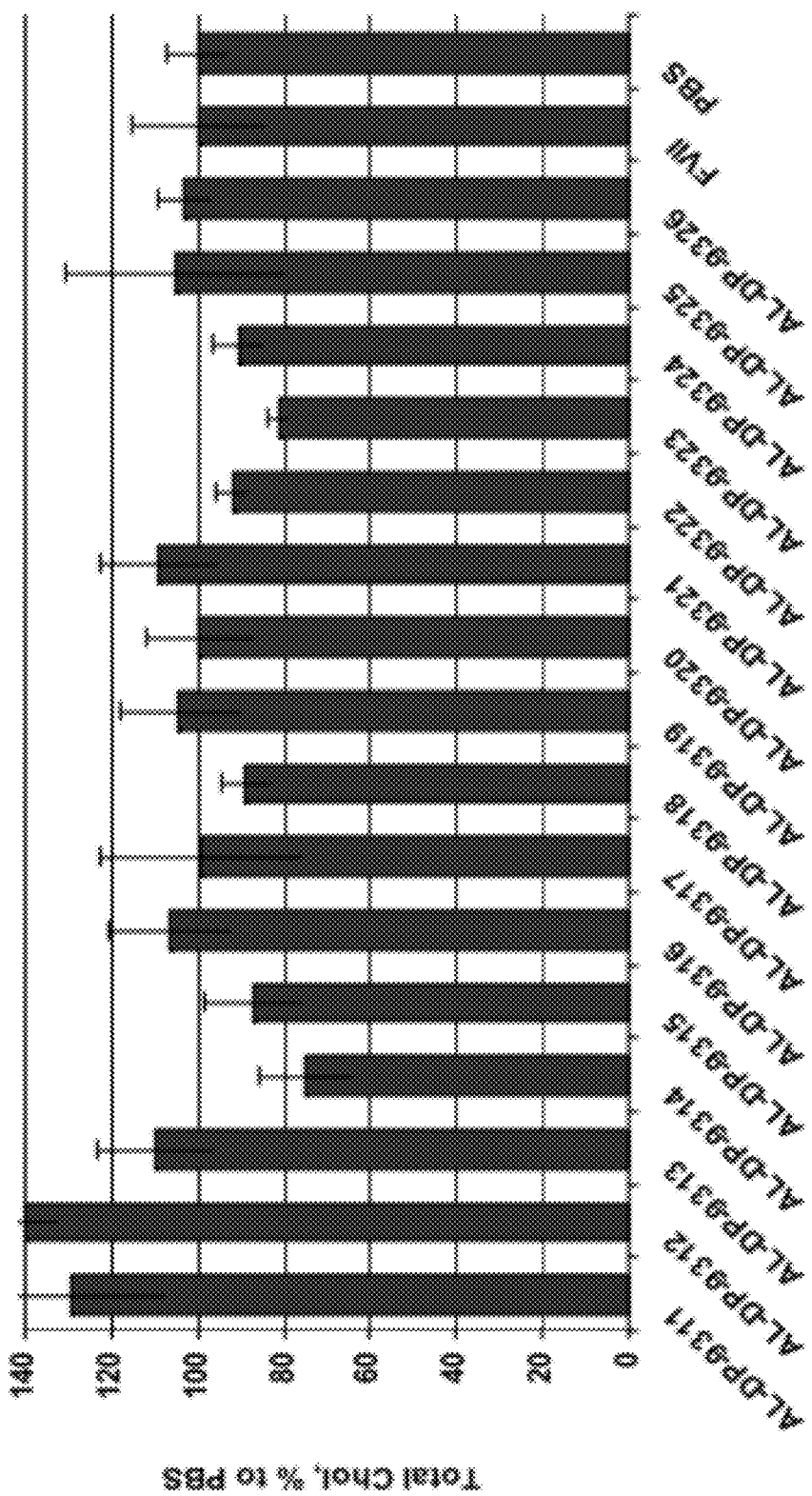
FIG. 5 shows the results of the in vivo screen of 16 human/mouse/rat cross-reactive (AL-DP-9311 through AL-DP-9326) PCSK9 siRNAs in C57/BL6 mice (5 animals/group). Total serum cholesterol levels were averaged over each treatment group and compared to a control group treated with PBS or a control group treated with an unrelated siRNA (blood coagulation factor VII).

At least 10 PCSK9 siRNAs showed more than 40% PCSK9 mRNA knock down compared to a control group treated with PBS, while control group treated with an unrelated siRNA (blood coagulation factor VII) had no effect (FIGS. 2-3). Silencing of PCSK9 transcript also correlated with a lowering of total serum cholesterol in these animals (FIGS. 4-5). The most efficacious siRNAs with respect to knocking down PCSK9 mRNAs also showed the most pronounced cholesterol lowering effects (compare FIGS. 2-3 and FIGS. 4-5). In addition there was a strong correlation between those molecules that were active in vitro and those active in vivo (compare FIGS. 6A and 6B).

Figure 7A:
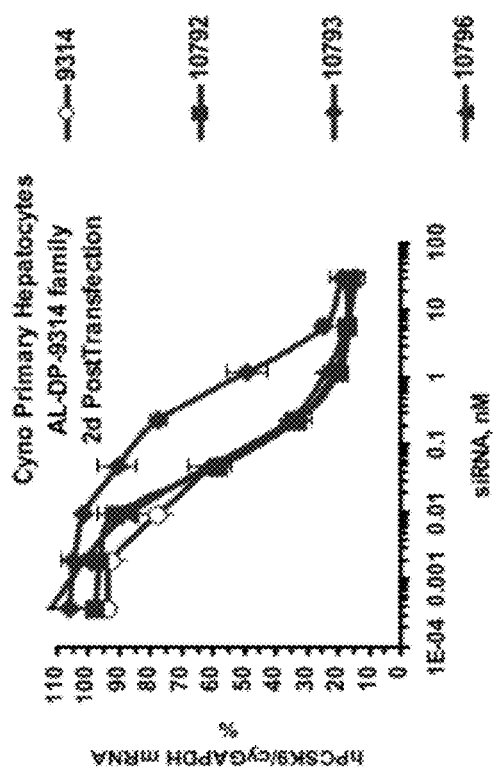
FIG. 7A and FIG. 7B are an example of in vitro results for silencing PCSK9 using monkey primary hepatocytes.
Figure 7B:
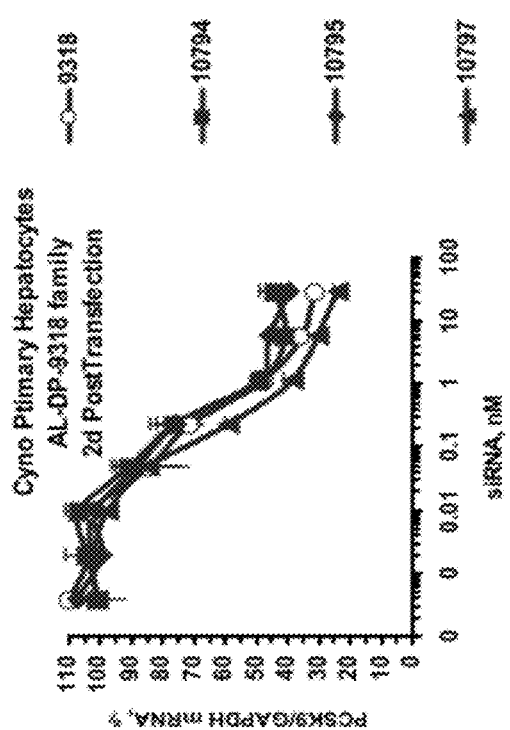
Figure 7C:
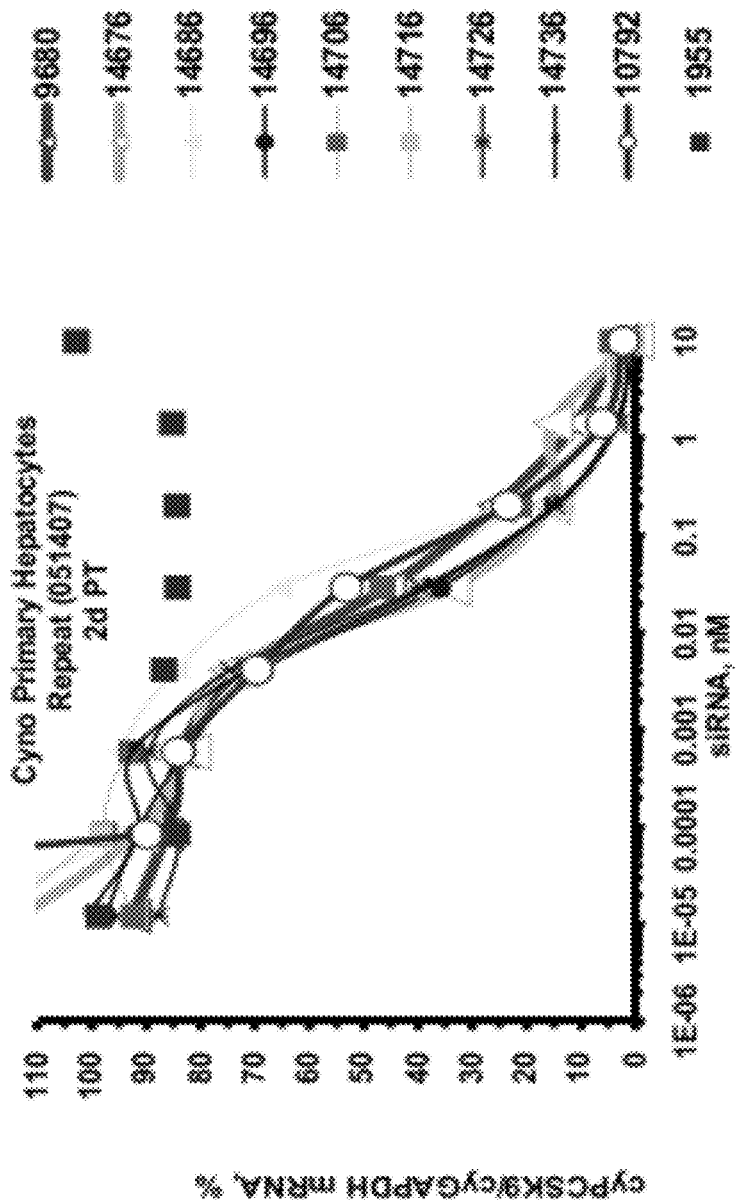
FIG. 7C show results for silencing of PCSK9 in monkey primary hepatocytes using AL-DP-9680 and chemically modified version of AL-DP-9680.
Figure 8:
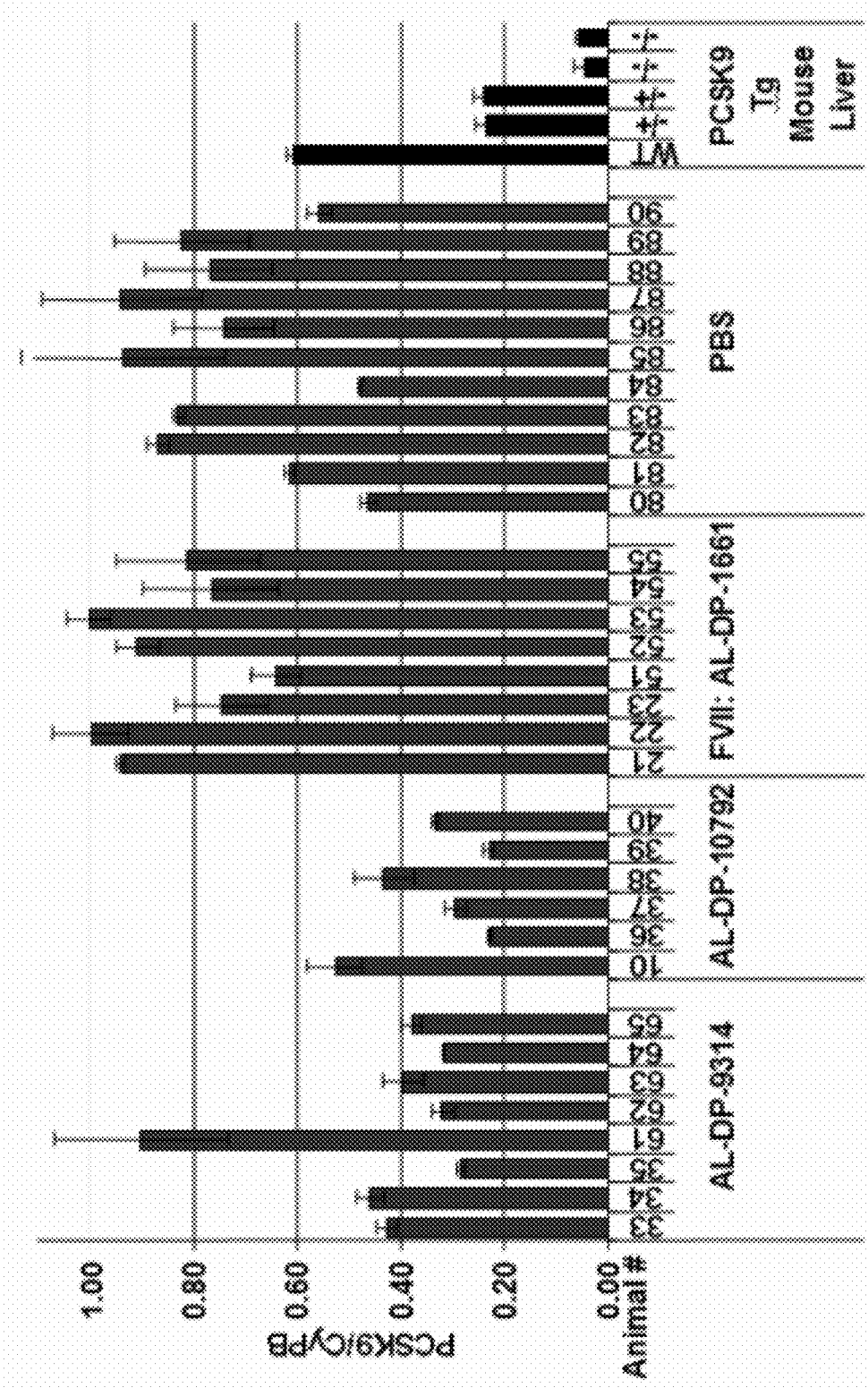
FIG. 8 shows in vivo activity of LNP-01 formulated siRNAs to PCSK-9.
Figure 9A:
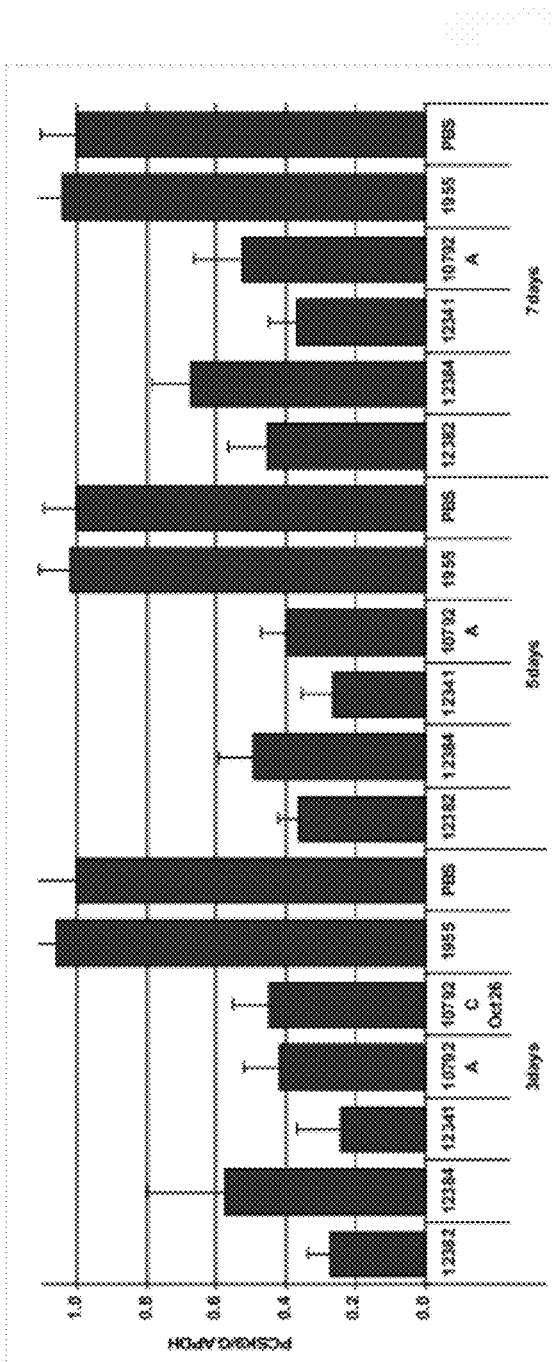
FIGS. 9A and 9B show in vivo activity of LNP-01 Formulated chemically modified 9314 and derivatives with chemical modifications such as AD-10792, AD-12382, AD-12384, AD-12341 at different times post a single dose in mice.
Figure 9B:
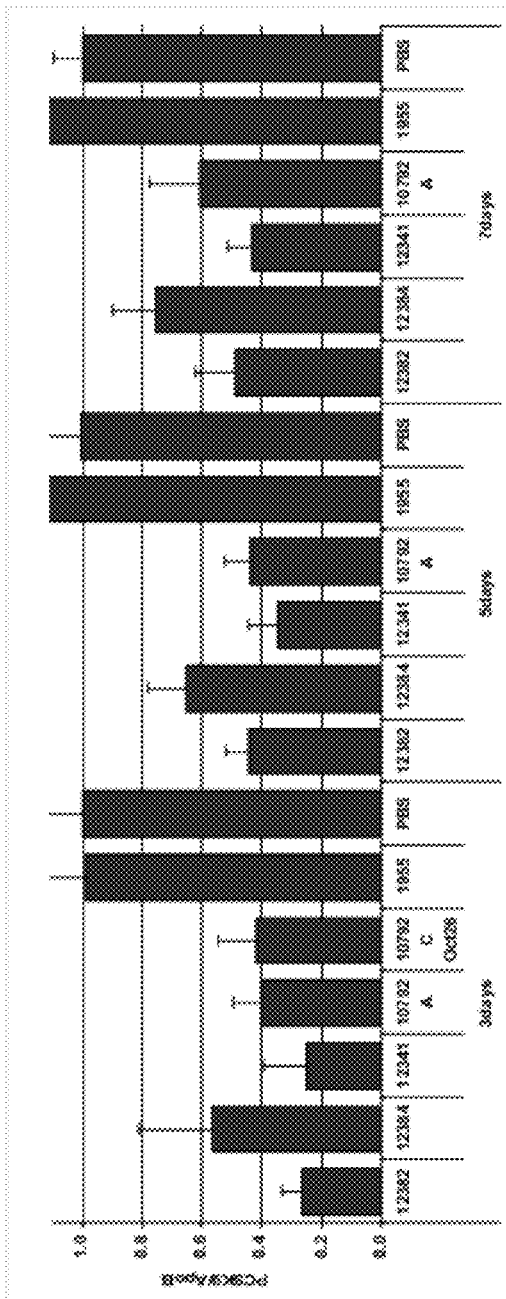

Sequences containing different chemical modifications were also screened in vitro (Tables 1 and 2) and in vivo. As an example, less modified sequences AD-9314 and AD-9318, and a more modified versions of that sequence AD-9314 (AD-10792, AD-10793, and AD-10796); AD-9318-(AD-10794, AD-10795, AD-10797) were tested both in vitro (in primary monkey hepatocytes) or in vivo (AD-9314 and AD-10792) formulated in LNP-01. FIG. 7 (also see Tables 1 and 2) shows that the parent molecules AD-9314 and AD-9318 and the modified versions were all active in vitro. FIG. 8 as an example shows that both the parent AD-9314 and the more highly modified AD-10792 sequences were active in vivo displaying 50-60% silencing of endogenous PCSK9 in mice. FIG. 9 further exemplifies that activity of other chemically modified versions of AD-9314 and AD-0792.

AD-3511, a derivative of AD-10792, was as efficacious as 10792 (IC50 of ~0.07-0.2 nM) (data not shown). The sequences of the sense and antisense strands of AD-3511 are as follows:

```
                                         SEQ ID NO: 1521
Sense strand: 5'-GccuGGAGuuuAuucGGAAdTsdT
```

```
                                         SEQ ID NO: 1522
Antisense strand: 5'-puUCCGAAuAAACUCcAGGCdTsdT
```

Example 5

PCSK9 Duration of Action Experiments in Rats and NHP

Rats

Rats were treated via tail vein injection with 5 mg/kg of LNP01-10792 (Formulated ALDP-10792). Blood was drawn at the indicated time points (see Table 3) and the amount of total cholesterol compared to PBS treated animals was measured by standard means. Total cholesterol levels decreased at day two ~60% and returned to baseline by day 28. These data show that formulated versions of PCSK9 siRNAs lower cholesterol levels for extended periods of time.

Monkeys

Cynomolgus monkeys were treated with LNP01 formulated dsRNA and LDL-C levels were evaluated. A total of 19 cynomolgus monkeys were assigned to dose groups. Beginning on Day −11, animals were limit-fed twice-a-day according to the following schedule: feeding at 9 a.m., feed removal at 10 a.m., feeding at 4 p.m., feed removal at 5 p.m. On the first day of dosing all animals were dosed once via 30-minute intravenous infusion. The animals were evaluated for changes in clinical signs, body weight, and clinical pathology indices, including direct LDL and HDL cholesterol.

Venipuncture through the femoral vein was used to collect blood samples. Samples were collected prior to the morning feeding (i.e., before 9 a.m.) and at approximately 4 hours (beginning at 1 p.m.) after the morning feeding on Days −3, −1, 3, 4, 5, and 7 for Groups 1-7; on Day 14 for Groups 1, 4, and 6; on Days 18 and 21 for Group 1; and on Day 21 for Groups 4 and 6. At least two 1.0 ml samples were collected at each time point.

No anticoagulant was added to the 1.0 ml serum samples, and the dry anticoagulant Ethylenediaminetetraacetic acid (K2) was added to each 1.0 ml plasma sample. Serum samples were allowed to stand at room temperature for at least 20 minutes to facilitate coagulation and then the samples were placed on ice. Plasma samples were placed on ice as soon as possible following sample collection. Samples were transported to the clinical pathology lab within 30 minutes for further processing.

Blood samples were processed to serum or plasma as soon as possible using a refrigerated centrifuge, per Testing Facility Standard operating procedure. Each sample was split into 3 approximately equal volumes, quickly frozen in liquid nitrogen, and placed at −70° C. Each aliquot should have had a minimum of approximately 50 µL. If the total sample volume collected was under 150 µL, the residual sample volume went into the last tube. Each sample was labeled with the animal number, dose group, day of collection, date, nominal collection time, and study number(s). Serum LDL cholesterol was measured directly per standard procedures on a Beckman analyzer according to manufactures instructions.

The results are shown in Table 4. LNP01-10792 and LNP01-9680 administered at 5 mg/kg decreased serum LDL cholesterol within 3 to 7 days following dose administration. Serum LDL cholesterol returned to baseline levels by Day 14 in most animals receiving LNP01-10792 and by Day 21 in animals receiving LNP01-9680. This data demonstrated a greater than 21 day duration of action for cholesterol lowering of LNP01 formulated ALDP-9680.

Example 6

PCSK9 siRNAs Cause Decreased PCSK mRNA in Liver Extracts, and Lower Serum Cholesterol Levels in Mice and Rats To test if acute silencing of the PCSK9 transcript by a PCSK9 siRNA (and subsequent PCSK9 protein down-regulation), would result in acutely lower total cholesterol levels, siRNA molecule AD-1a2 (AD-10792) was formulated in an LNP01 lipidoid formulation. Sequences and modifications of these dsRNAs are shown in Table 5a. Liposomal formulated siRNA duplex AD-1a2 (LNP01-1a2) was injected via tail vein in low volumes (~0.2 ml for mouse and ~1.0 ml for rats) at different doses into C57/BL6 mice or Sprague Dawley rats.

Figures 14A, 14B:
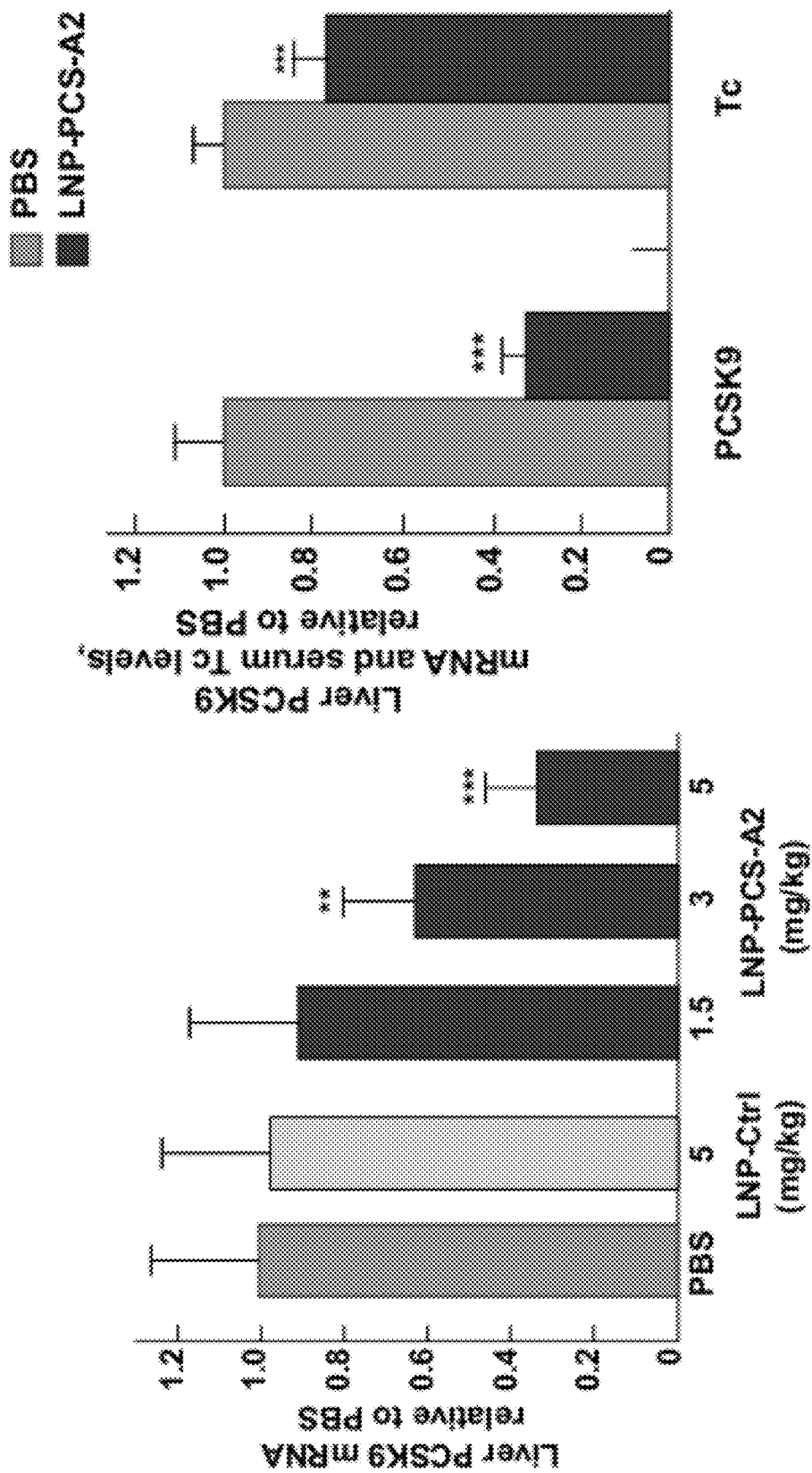
FIG. 14A is a graph showing that the PCSK9 siRNA siRNA-AD-1A2 (a.k.a. LNP-PCS-A2 or a.k.a. "formulated AD-10792") decreased PCSK9 mRNA levels in mice liver in a dose-dependent manner.
FIG. 14B is a graph showing that single administration of 5 mg/kg siRNA-AD-1A2 decreased serum total cholesterol levels in mice within 48 hours.

In mice, livers were harvested 48 hours post-injection, and levels of PCSK9 transcript were determined. In addition to liver, blood was harvested and subjected to a total cholesterol analysis. LNP01-1a2 displayed a clear dose response with maximal PCSK9 message suppression (~60-70%) as compared to a control siRNA targeting luciferase (LNP01-ctrl) or PBS treated animals (FIG. 14A). The decrease of PCSK9 transcript at the highest dose translated into a ~30% lowering of total cholesterol in mice (FIG. 14B). This level of cholesterol reduction is between that reported for heterozygous and homozygous PCSK9 knock-out mice (Rashid et al., Proc. Natl. Acad. Sci. USA 102:5374-9, 2005, epub Apr. 1, 2005). Thus, lowering of PCSK9 transcript through an RNAi mechanism is capable of acutely decreasing total cholesterol in mice. Moreover the effect on the PCSK9 transcript persisted between 20-30 days, with higher doses displaying greater initial transcript level reduction, and subsequently more persistent effects.

Figure 10A:
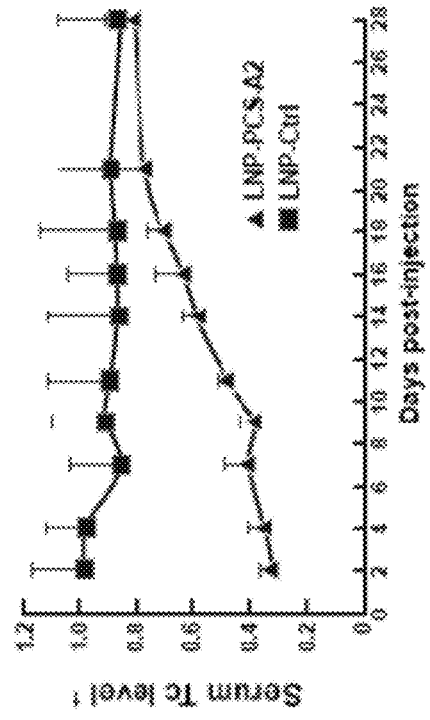
FIG. 10A shows the effect of PCSK9 siRNAs on PCSK9 transcript levels and total serum cholesterol levels in rats after a single dose of formulated AD-10792.
Figure 10B:
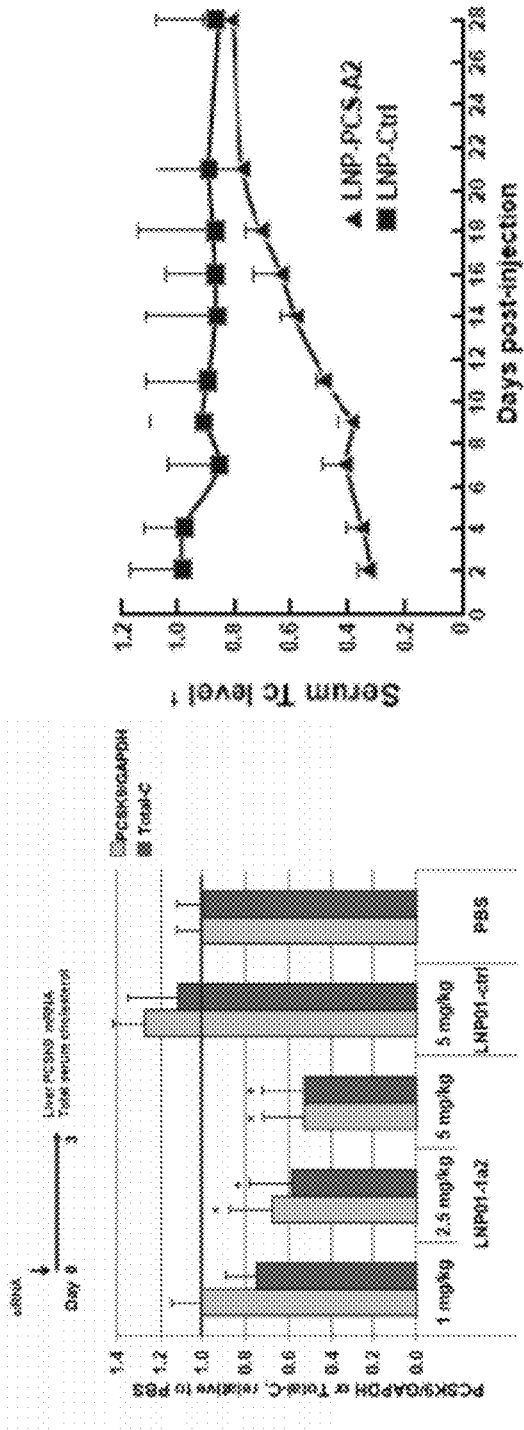
FIG. 10B shows the effect of PCSK9 siRNAs on serum total cholesterol levels in the experiment as 10A. A single dose of formulated AD-10792 results in an ~60% lowering of total cholesterol in the rats that returns to baseline by ~3-4 weeks.

Down-modulation of total cholesterol in rats has been historically difficult as cholesterol levels remain unchanged even at high doses of HMG-CoA reductase inhibitors. Interestingly, as compared to mice, rats appear to have a much higher level of PCSK9 basal transcript levels as measured by bDNA assays. Rats were dosed with a single injection of LNP01-a2 via tail vein at 1, 2.5 and 5 mg/kg. Liver tissue and blood were harvested 72 hours post-injection. LNP01-1a2 exhibited a clear dose response effect with maximal 50-60% silencing of the PCSK9 transcript at the highest dose, as compared to a control luciferase siRNA and PBS (FIG. 10A). The mRNA silencing was associate with an acute ~50-60% decrease of serum total cholesterol (FIGS. 10A and 10B) lasting 10 days, with a gradual return to pre-dose levels by ~3 weeks (FIG. 10B). This result demonstrated that lowering of PCSK9 via siRNA targeting had acute, potent and lasting effects on total cholesterol in the rat model system. To confirm that the transcript reduction observed was due to a siRNA mechanism, liver extracts from treated or control animals were subjected to 5' RACE, a method previously utilized to demonstrate that the predicted siRNA cleavage event occurs (Zimmermann et al., Nature. 441:111-4, 2006, Epub 2006 Mar. 26). PCR amplification and detection of the predicted site specific mRNA cleavage event was observed in animals treated with LNP01-1a2, but not PBS or LNP01-ctrl control animals. (Frank-Kamanetsky et al. (2008) PNAS 105:119715-11920) This result demonstrated that the effects of LNP01-1a2 observed were due to cleavage of the PCSK9 transcript via an siRNA specific mechanism.

Figure 11:
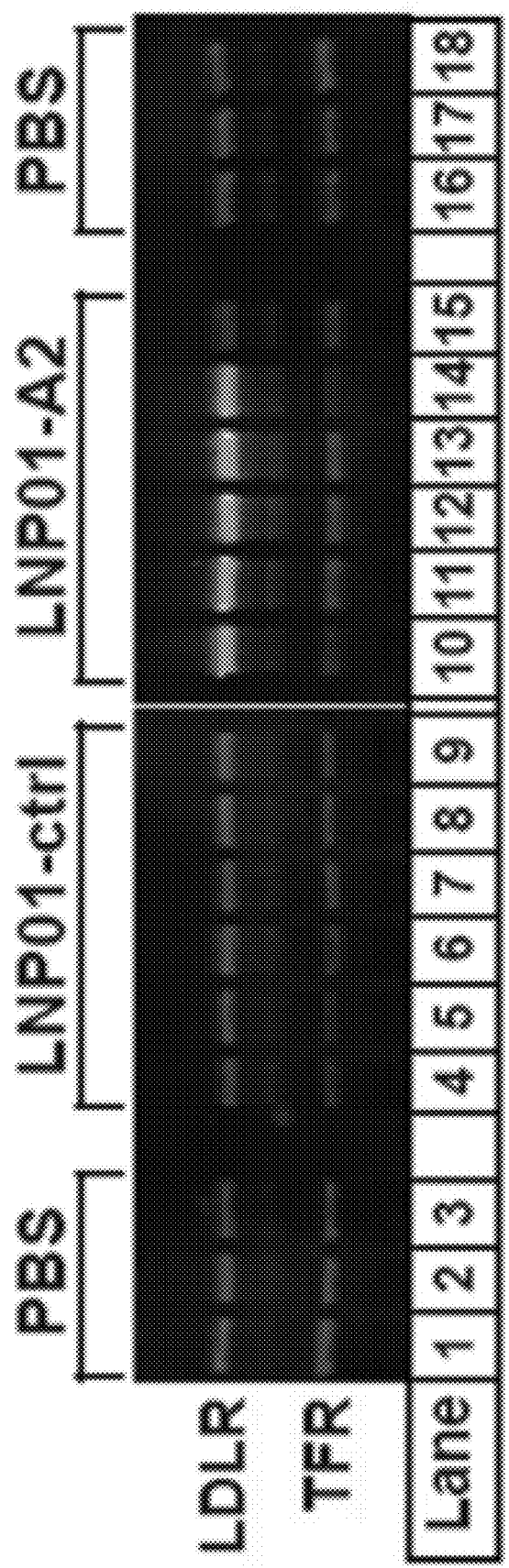
FIG. 11 is a Western blot showing that liver LDL receptor levels were upregulated following administration of PCSK9 siRNAs in rat.

The mechanism by which PCSK9 impacts cholesterol levels has been linked to the number of LDLRs on the cell surface. Rats (as opposed to mice, NHP, and humans) control their cholesterol levels through tight regulation of cholesterol synthesis and to a lesser degree through the control of LDLR levels. To investigate whether modulation of LDLR was occurring upon RNAi therapeutic targeting of PCSK9, we quantified the liver LDLR levels (via western blotting) in rats treated with 5 mg/kg LNP01-1a2. As shown in FIG. 11, LNP01-1a2 treated animals had a significant (~3-5 fold average) induction of LDLR levels 48 hours post a single dose of LNP01-1a2 compared to PBS or LNP01-ctrl control siRNA treated animals.

Figure 10C:
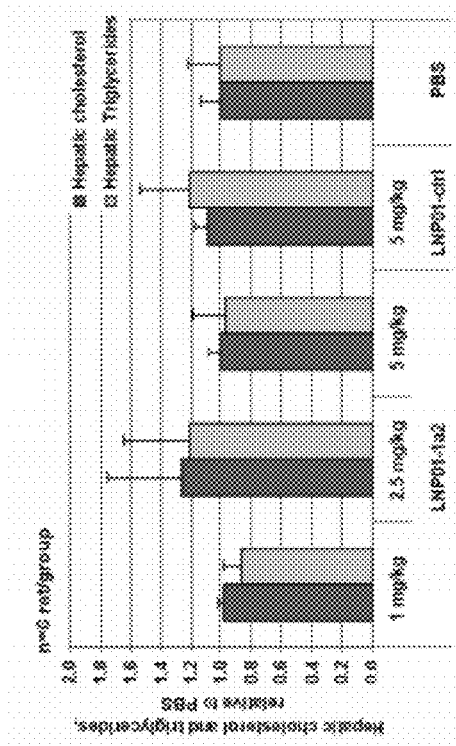
FIG. 10C shows the effect of PCSK9 siRNAs on hepatic cholesterol and triglyceride levels in the same experiment as 10A.

Assays were also performed to test whether reduction of PCSK9 changes the levels of triglycerides and cholesterol in the liver itself. Acute lowering of genes involved in VLDL assembly and secretion such as microsomal triglyceride transfer protein (MTP) or ApoB by genetic deletion, compounds, or siRNA inhibitors results in increased liver triglycerides (see, e.g., Akdim et al., Curr. Opin. Lipidol. 18:397-400, 2007). Increased clearance of plasma cholesterol induced by PCSK9 silencing in the liver (and a subsequent increase in liver LDLR levels) was not predicted to result in accumulation of liver triglycerides. However, to address this possibility, liver cholesterol and triglyceride concentrations in livers of the treated or control animals were quantified. As shown in FIG. 10C, there was no statistical difference in liver TG levels or cholesterol levels of rats administered PCSK9 siRNAs compared to the controls. These results indicated that PCSK9 silencing and subsequent cholesterol lowering is unlikely to result in excess hepatic lipid accumulation.

Example 7

Additional Modifications to siRNAs do not Affect Silencing and Duration of Cholesterol Reduction in Rats Phosphorothioate modifications at the 3' ends of both sense and antisense strands of a dsRNA can protect against exonucleases. 2'OMe and 2'F modifications in both the sense and antisense strands of a dsRNA can protect against endonucleases. AD-1a2 (see Table 5b) contains 2'OMe modifications on both the sense and antisense strands. Experiments were performed to determine if the inherent stability (as measured by siRNA stability in human serum) or the degree or type of chemical modification (2'OMe versus 2'F or a mixture) was related to either the observed rat efficacy or the duration of silencing effects. Stability of siRNAs with the same AD-1a2 core sequence, but containing different chemical modifications were created and tested for activity in vitro in primary Cyno monkey hepatocytes. A series of these molecules that maintained similar activity as measured by in vitro IC50 values for PCSK9 silencing (Table 5b), were then tested for their stability against exo and endonuclease cleavage in human serum. Each duplex was incubated in human serum at 37° C. (a time course), and subjected to HPLC analysis. The parent sequence AD-1a2 had a T½ of ~7 hours in pooled human serum. Sequences AD-1a3, AD-1a5, and AD-1a4, which were more heavily modified (see chemical modifications in Table 5) all had T½'s greater than 24 hours. To test whether the differences in chemical modification or stability resulted in changes in efficacy, AD-1a2, AD-1a3, AD-1a5, AD-1a4, and an AD-control sequence were formulated and injected into rats. Blood was collected from animals at various days post-dose, and total cholesterol concentrations were measured. Previous experiments had shown a very tight correlation between the lowering of PCSK9 transcript levels and total cholesterol values in rats treated with LNP01-1a2 (FIG. 10A). All four molecules were observed to decrease total cholesterol by ~60% day 2 post-dose (versus PBS or control siRNA), and all of the molecules had equal effects on total cholesterol levels displaying similar magnitude and duration profiles. There was no statistical difference in the magnitude of cholesterol lowering and the duration of effect demonstrated by these molecules, regardless of their different chemistries or stabilities in human serum.

Example 8

Figures 15A, 15B:
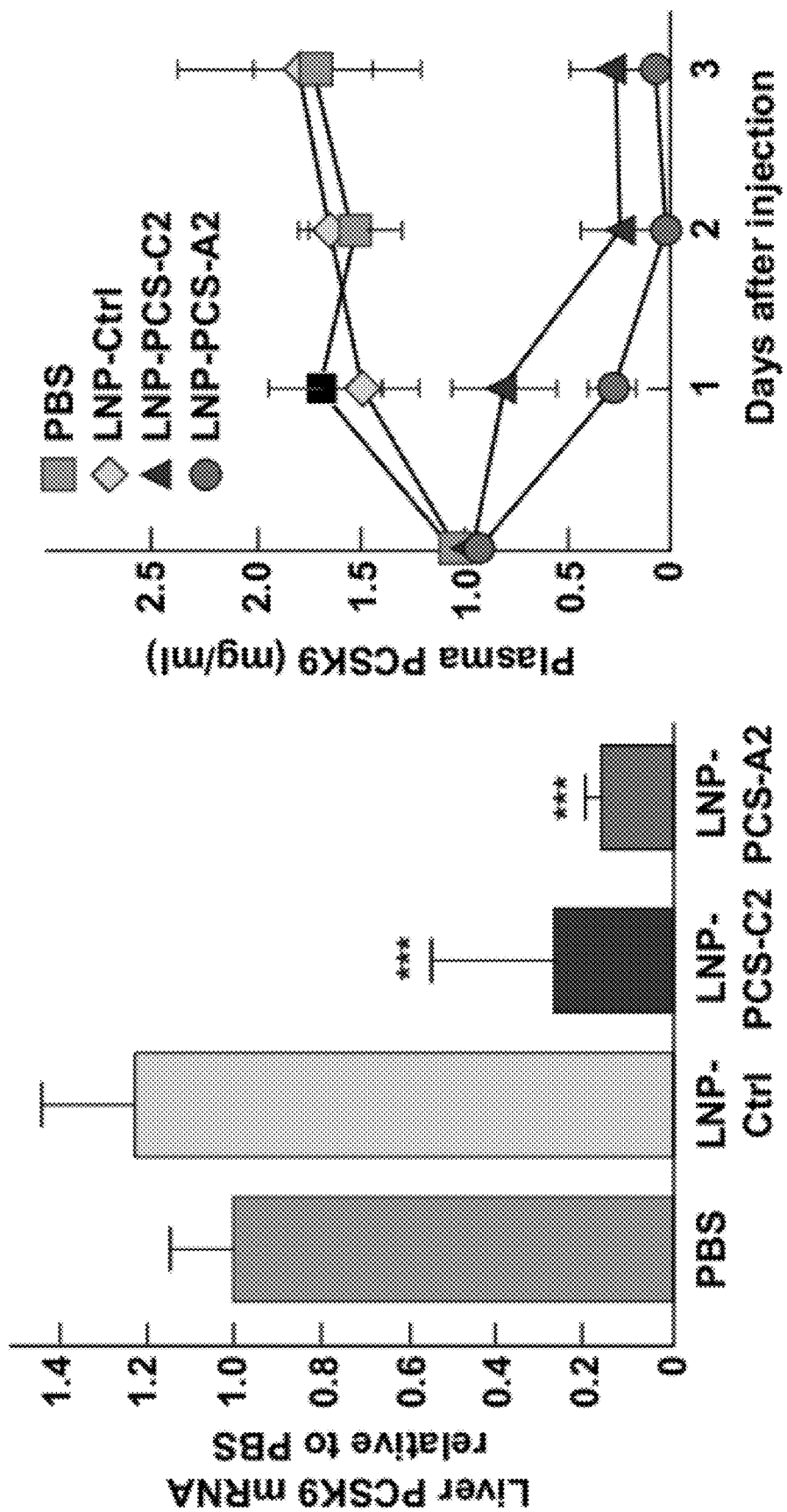
FIG. 15A is a graph showing that PCSK9 siRNAs targeting human and monkey PCSK9 (LNP-PCS-C2) (a.k.a. "formulated AD-9736"), and PCSK9 siRNAs targeting mouse PCSK9 (LNP-PCS-A2) (a.k.a. "formulated AD-10792"), reduced liver PCSK9 levels in transgenic mice expressing human PCSK9.
FIG. 15B is a graph showing that LNP-PCS-C2 and LNP-PCS-A2 reduced plasma PCSK9 levels in the same transgenic mice.

LNP01-1a2 and LNP01-3a1 Silence Human PCSK9 and Circulating Human PCSK9 Protein in Transgenic Mice The efficacy of LNP01-1a2 (i.e., PCS-A2 or AD-10792) and another molecule, AD-3a1 (i.e., PCS-C2 or AD-9736) (which targets only human and monkey PCSK9 message), to silence the human PCSK9 gene was tested in vivo. A line of transgenic mice expressing human PCSK9 under the ApoE promoter was used (Lagace et al., *J Clin Invest.* 116:2995-3005, 2006). Specific PCR reagents and antibodies were designed that detected the human but not the mouse transcripts and protein respectively. Cohorts of the humanized mice were injected with a single dose of LNP01-1a2 (a.k.a. LNP-PCS-A2) or LNP01-3a1 (a.k.a. LNP-PCS-C2), and 48 hours later both livers and blood were collected. A single dose of LNP01-1a2 or LNP01-3a1 was able to decrease the human PCSK9 transcript levels by >70% (FIG. 15A), and this transcript down-regulation resulted in significantly lower levels of circulating human PCSK9 protein as measured by ELISA (FIG. 15B). These results demonstrated that both siRNAs were capable of silencing the human transcript and subsequently reducing the amount of circulating plasma human PCSK9 protein.

Example 9

Secreted PCSK9 Levels are Regulated by Diet in NHP

In mice, PCSK9 mRNA levels are regulated by the transcription factor sterol regulatory element binding protein-2 and are reduced by fasting. In clinical practice, and standard NHP studies, blood collection and cholesterol levels are measured after an over-night fasting period. This is due in part to the potential for changes in circulating TGs to interfere with the calculation of LDLc values. Given the regulation of PCSK9 levels by fasting and feeding behavior in mice, experiments were performed to understand the effect of fasting and feeding in NHP.

Cyno monkeys were acclimated to a twice daily feeding schedule during which food was removed after a one hour period. Animals were fed from 9-10 am in the morning, after which food was removed. The animals were next fed once again for an hour between 5 pm-6 pm with subsequent food removal. Blood was drawn after an overnight fast (6 pm until 9 am the next morning), and again, 2 and 4 hours following the 9 am feeding. PCSK9 levels in blood plasma or serum were determined by ELISA assay (see Methods). Interestingly, circulating PCSK9 levels were found to be higher after the overnight fasting and decreased 2 and 4 hours after feeding. This data was consistent with rodent models where PCSK9 levels were highly regulated by food intake. However, unexpectedly, the levels of PCSK9 went down the first few hours post-feeding. This result enabled a more carefully designed NHP experiment to probe the efficacy of formulated AD-1a2 and another PCSK9 siRNA (AD-2a1) that was highly active in primary Cyno hepatocytes.

Example 10

PCSK9 siRNAs Reduce Circulating LDLc, ApoB, and PCSK9, but not HDLc in Non-Human Primates (NHPs)

siRNAs targeting PCSK9 acutely lowered both PCSK9 and total cholesterol levels by 72 hours post-dose and lasted ~21-30 days after a single dose in mice and rats. To extend these findings to a species whose lipoprotein profiles most closely mimic that of humans, further experiments were performed in the Cynomologous (Cyno) monkey model.

siRNA 1 (LNP01-10792) and siRNA 2 (LNP-01-9680), both targeting PCSK9 were administered to cynomologous monkeys. As shown in FIG. 12, both siRNAs caused significant lipid lowering for up to 7 days post administration. siRNA 2 caused ~50% lipid lowering for at least 7 days post-administration, and ~60% lipid lowering at day 14 post-administration, and siRNA 1 caused ~60% LDLc lowering for at least 7 days.

Male Cynos were first pre-screened for those that had LDLc of 40 mg/dl or higher. Chosen animals were then put on a fasted/fed diet regime and acclimated for 11 days. At day –3 and –1 pre-dose, serum was drawn at both fasted and 4 hours post-fed time points and analyzed for total cholesterol (Tc), LDL (LDLc), HDL cholesterol (HDLc) as well as triglycerides (TG), and PCSK9 plasma levels. Animals were randomized based on their day –3 LDLc levels. On the day of dosing (designated day 1), either 1 mg/kg or 5 mg/kg of LNP01-1a2 and 5 mg/kg LNP01-2a1 were injected, along with PBS and 1 mg/kg LNP01-ctrl as controls. All doses were well tolerated with no in-life findings. As the experiment progressed it became apparent (based on LDLc lowering) that the lower dose was not efficacious. We therefore dosed the PBS group animals on day 14 with 5 mg/kg LNP01-ctrl control siRNA, which could then serve as an additional control for the high dose groups of 5 mg/kg LNP01-1a2 and 5 mg/kg LNP01-2a1. Initially blood was drawn from animals on days 3, 4, 5, and 7 post-dose and Tc, HDLc, LDLc, and TGs concentrations were measured. Additional blood draws from the LNP01-1a2, LNP01-2a1 high dose groups were carried out at day 14 and day 21 post-dose (as the LDLc levels had not returned to baseline by day 7).

Figures 12A, 12B:
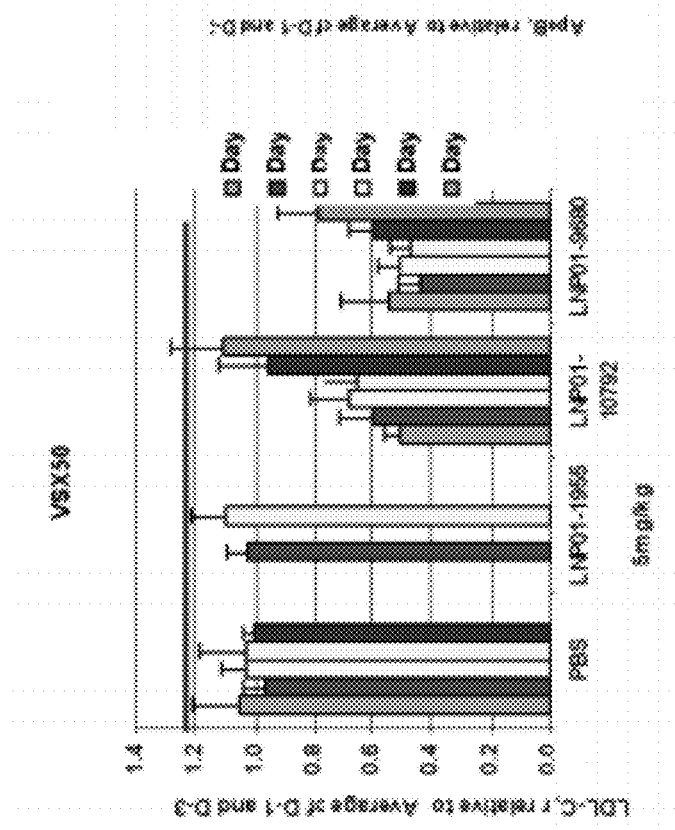
FIGS. 12A-12D show the effects of PCSK9 siRNAs on LDLc and ApoB protein levels, total cholesterol/HDLc ratios, and PCSK9 protein levels, respectively, in non-human primates following a single dose of formulated AD-10792 or AD-9680.
Figures 12C, 12D:
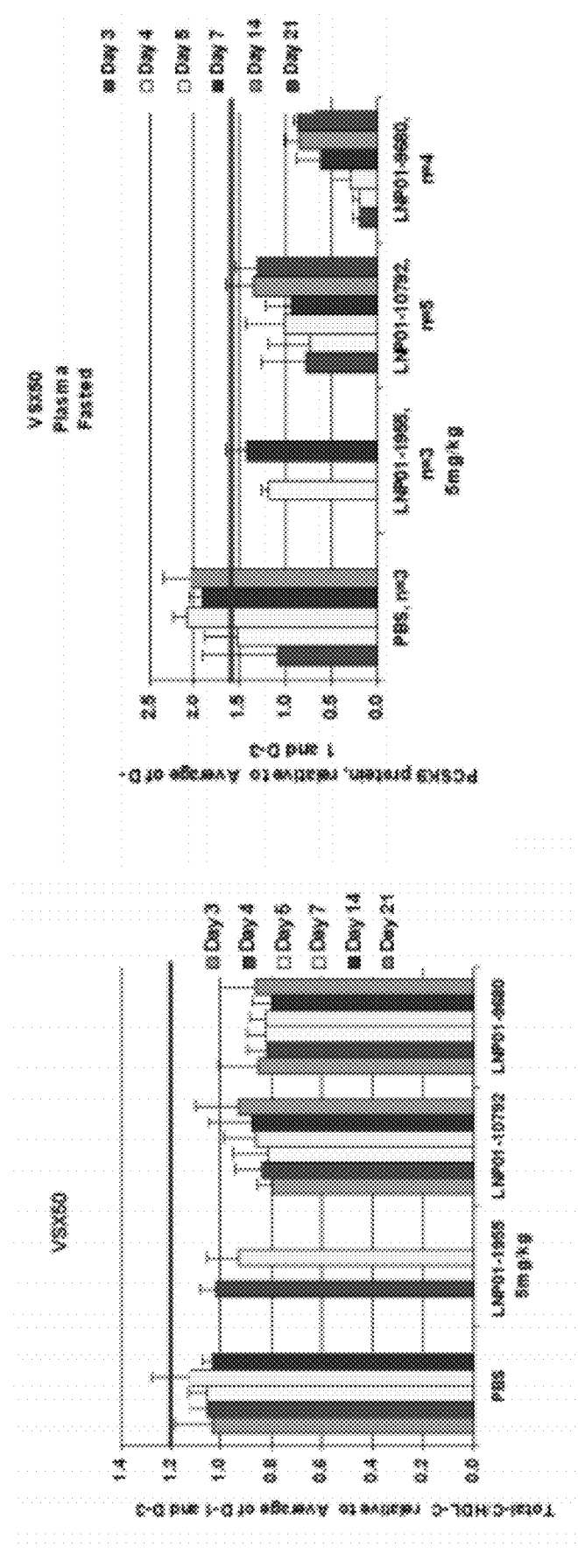

As shown in FIG. 12A, a single dose of LNP01-1a2 or LNP01-2a1 resulted in a statistically significant reduction of LDLc beginning at day 3 post-dose that returned to baseline over ~14 days (for LNP01-1a2) and ~21 days (LNP01-2a1). This effect was not seen in either the PBS, the control siRNA groups, or the 1 mg/kg treatment groups. LNP01-2a1 resulted in an average lowering of LDLc of 56% 72 hours post-dose, with 1 of 4 animals achieving nearly 70% LDLc, and all others achieving >50% LDLc decrease, as compared to pre-dose levels, (see FIG. 12A. As expected, the lowering of LDLc in the treated animals also correlated with a reduction of circulating ApoB levels as measured by serum ELISA (FIG. 12B). Interestingly, the degree of LDLc lowering observed in this study of Cyno monkey was greater than those that have been reported for high dose statins, as well as, for other current standard of care compounds used for hypercholesterolemia. The onset of action is also much more acute than that of statins with effects being seen as early as 48 hours post-dose.

Neither LNP01-1a2 nor LNP01-2a1 treatments resulted in a lowering of HDLc. In fact, both molecules resulted (on average) in a trend towards a decreased Tc/HDL ratio (FIG.

12C). In addition, circulating triglyceride levels, and with the exception of one animal, ALT and AST levels were not significantly impacted.

PCSK9 protein levels were also measured in treated and control animals. As shown in FIG. 11, LNP01-1a2 and LNP01-2a1 treatment each resulted in trends toward decreased circulating PCSK9 protein levels versus pre-dose. Specifically, the more active siRNA LNP01-2a1 demonstrated significant reduction of circulating PCSK9 protein versus both PBS (day 3-21) and LNP01-ctrl siRNA control (day 4, day 7).

Example 11

Figures 13A, 13B:
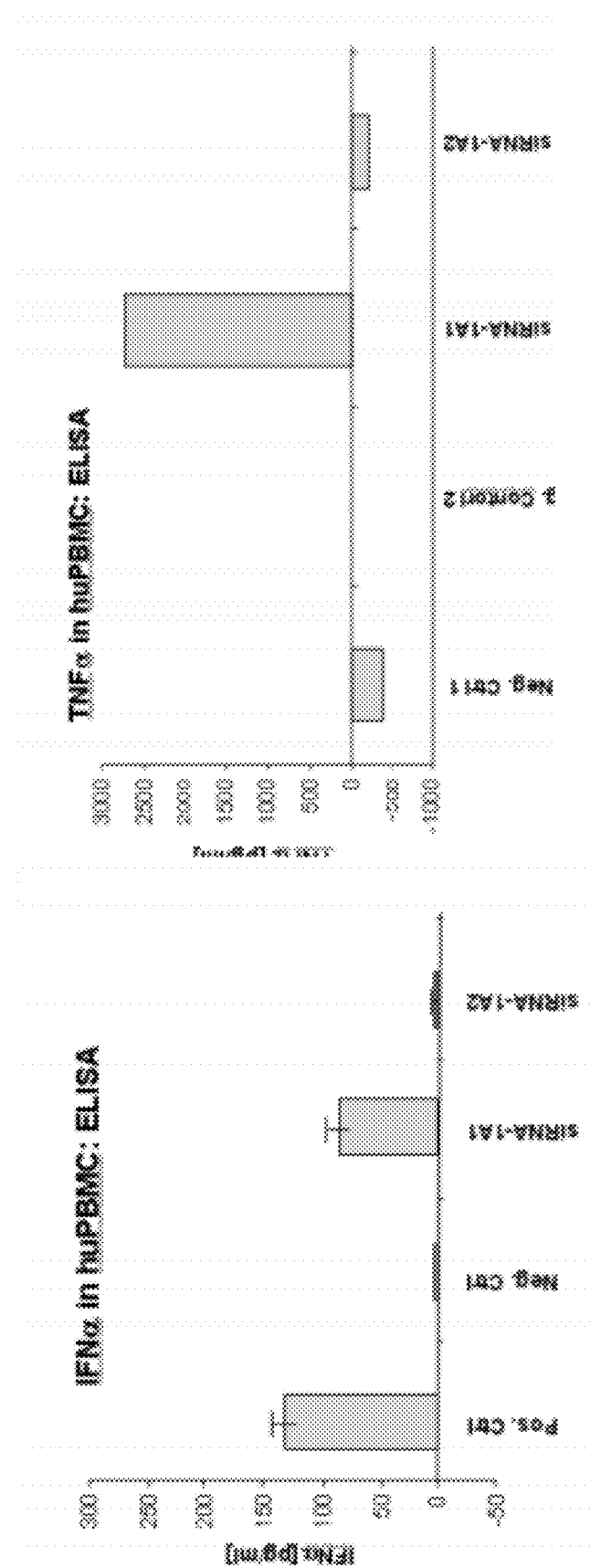
FIG. 13A is a graph showing that unmodified siRNA-AD-A1A (AD-9314), but not 2'OMe modified siRNA-AD-1A2 (AD-10792), induced IFN-alpha in human primary blood monocytes.
FIG. 13B is a graph showing that unmodified siRNA-AD-A1A (AD-9314), but not 2'OMe modified siRNA-AD-1A2 (AD-10792), also induced TNF-alpha in human primary blood monocytes.

Modified siRNA and Activation of Immune Responses in hPBMCs siRNAs were tested for activation of the immune system in primary human blood monocytes (hPBMC). Two control inducing sequences and the unmodified parental compound AD-1a1 was found to induce both IFN-alpha and TNF-alpha. However, chemically modified versions of this sequence (AD-1a2, AD-1a3, AD-1a5, and AD-1a4) as well as AD-2a1 were negative for both IFN-alpha and TNF-alpha induction in these same assays (see Table 5, and FIGS. 13A and 13B). Thus chemical modifications are capable of dampening both IFN-alpha and TNF-alpha responses to siRNA molecules. In addition, neither AD-1a2, nor AD-2a1 activated IFN-alpha when formulated into liposomes and tested in mice.

Example 12

Evaluation of siRNA Conjugates in Mice

Figure 17:
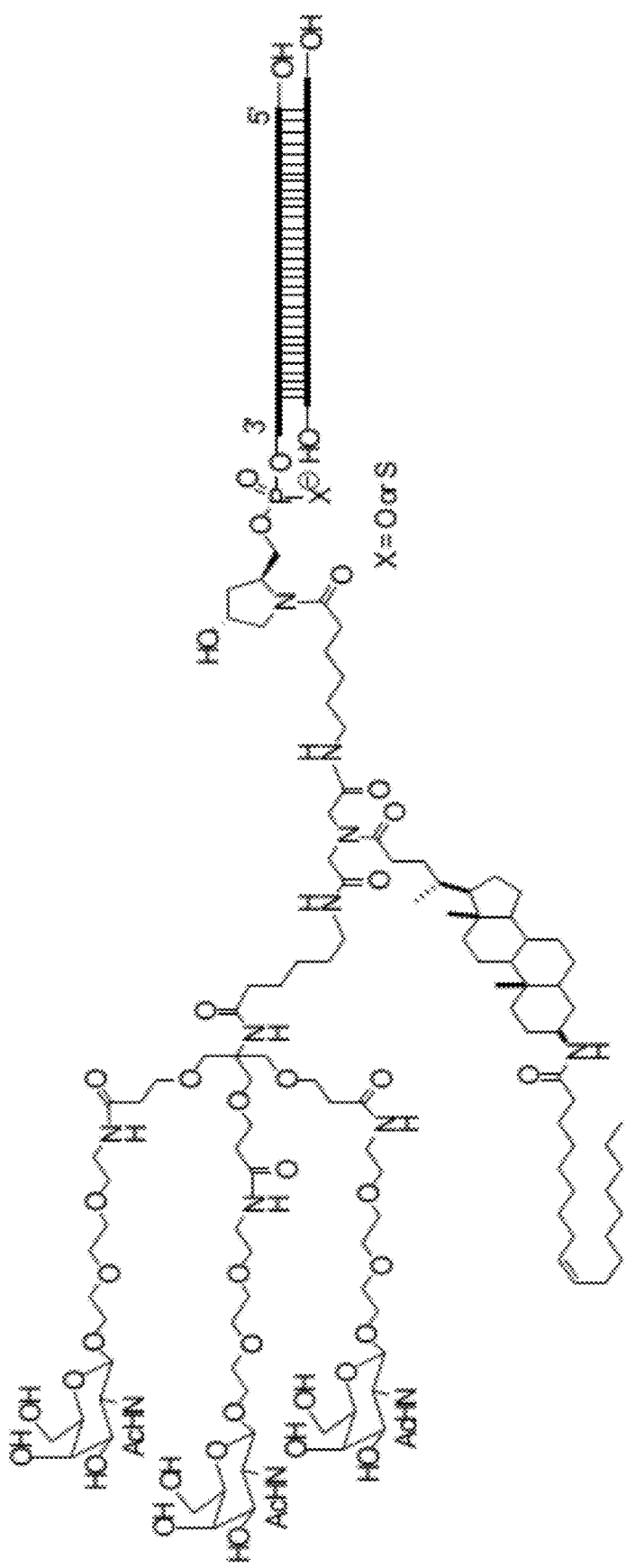
FIG. 17 shows the structure of an siRNA conjugated to LCO(GalNAc)3 (a (GalNAc)3-3'-Lithocholic-oleoyl siRNA Conjugate).

AD-10792 was conjugated to GalNAc)3/Cholesterol (FIG. 16) or GalNAc)3/LCO (FIG. 17). The sense strand was synthesized with the conjugate on the 3' end. The conjugated siRNAs were assayed for effects on PCSK9 transcript levels and total serum cholesterol in mice using the methods described below.

Briefly, mice were dosed via tail injection with one of the 2 conjugated siRNAs or PBS on three consecutive days: day 0, day 1 and day 2 with a dosage of about 100, 50, 25 or 12.5 mg/kg. Each dosage group included 6 mice. 24 hour post last dosing mice were sacrificed and blood and liver samples were obtained, stored, and processed to determine PCSK9 mRNA levels and total serum cholesterol.

Figure 18:
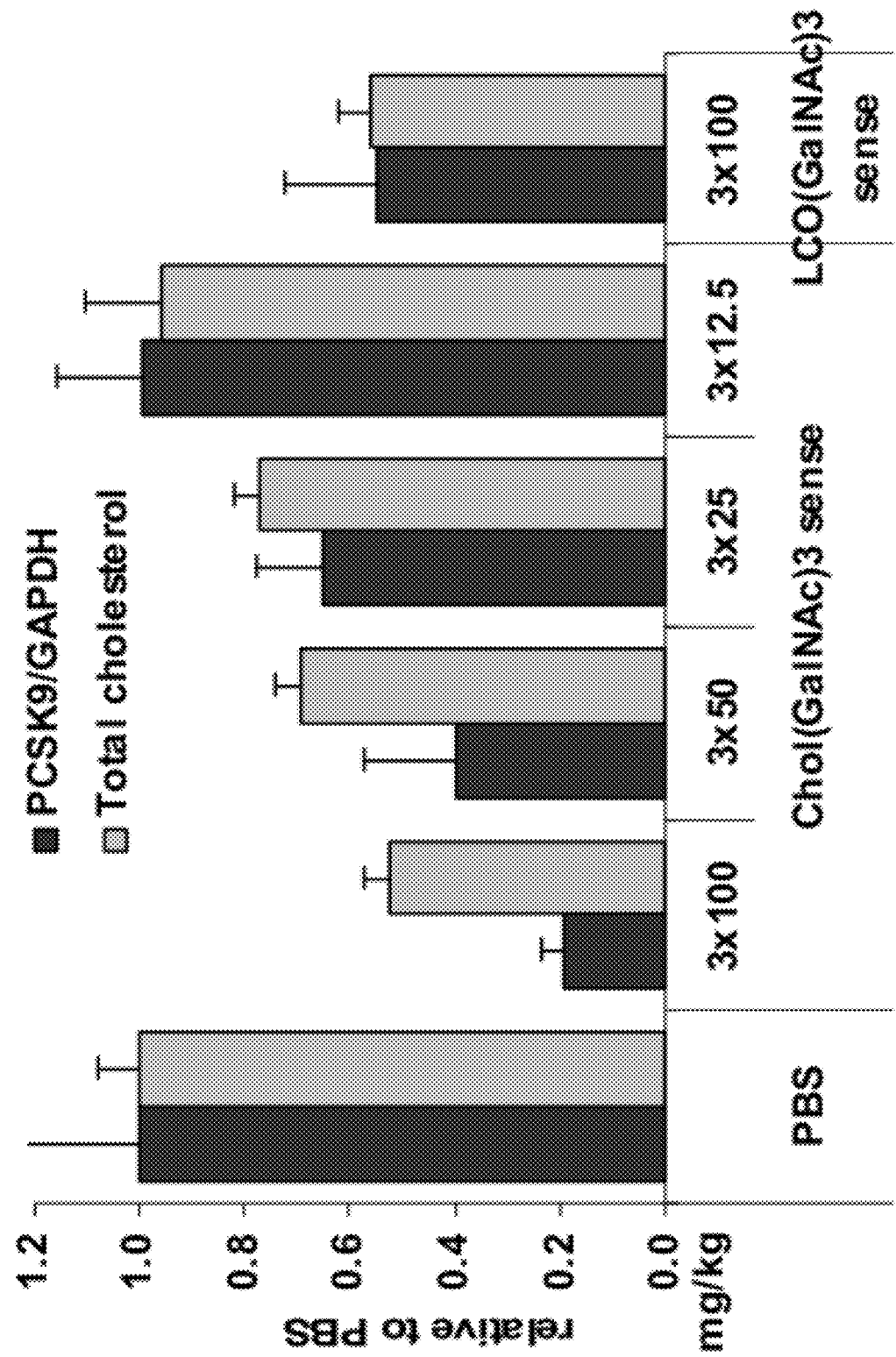
FIG. 18 is a graph showing the results of conjugated siRNAs on PCSK9 transcript levels and total serum cholesterol in mice.

The results are shown in FIG. 18. Compared to control PBS, both siRNA conjugates demonstrated activity with an ED50 of 3×50 mg/kg for GalNAc)3/Cholesterol conjugated AD-10792 and 3×100 mg/kg for GalNAc)3/LCO conjugated AD-10792. The results indicate that Cholesterol conjugated siRNA with GalNAc are active and capable of silencing PCSK9 in the liver resulting in cholesterol lowering.

Bolus Dosing

Bolus dosing of formulated siRNAs in C57/BL6 mice (6/group, 8-10 weeks old, Charles River Laboratories, MA) was performed by tail vein injection using a 27G needle. SiRNAs were formulated in LNP-01 (and then dialyzed against PBS) and diluted with PBS to concentrations 1.0, 0.5, 0.25 and 0.125 mg/ml allowing the delivery of 100; 50; 25 and 12.5 mg/kg doses in 10 µl/g body weight. Mice were kept under an infrared lamp for approximately 3 min prior to dosing to ease injection.

24 hour post last dose mice were sacrificed by CO2-asphyxiation. 0.2 ml blood was collected by retro-orbital bleeding and the liver was harvested and frozen in liquid nitrogen. Serum and livers were stored at −80° C. Frozen livers were grinded using 6850 Freezer/Mill Cryogenic Grinder (SPEX CentriPrep, Inc) and powders stored at −80° C. until analysis.

PCSK9 mRNA levels were detected using the branched-DNA technology based kit from QuantiGene Reagent System (Panomics, USA) according to the protocol. 10-20 mg of frozen liver powders was lysed in 600 µl of 0.16 µg/ml Proteinase K (Epicentre, #MPRK092) in Tissue and Cell Lysis Solution (Epicentre, #MTC096H) at 65° C. for 3 hours. Then 10 µl of the lysates were added to 90 µl of Lysis Working Reagent (1 volume of stock Lysis Mixture in two volumes of water) and incubated at 52° C. overnight on Genospectra capture plates with probe sets specific to mouse PCSK9 and mouse GAPDH. Probes sets for mouse PCSK9 and mouse GAPDH were purchased from Panomics, USA. Chemo luminescence was read on a Victor2-Light (Perkin Elmer) as Relative light units. The ratio of PCSK9 mRNA to mGAPDH mRNA in liver lysates was averaged over each treatment group and compared to a control group treated with PBS or a control group treated with an unrelated siRNA (blood coagulation factor VII).

Total serum cholesterol in mouse serum was measured using the Total Cholesterol Assay (Wako, USA) according to manufacturer's instructions. Measurements were taken on a Victor2 1420 Multilabel Counter (Perkin Elmer) at 600 nm.

Example 13

Evaluation of Lipid Formulated siRNAs in Rats

Figure 19:
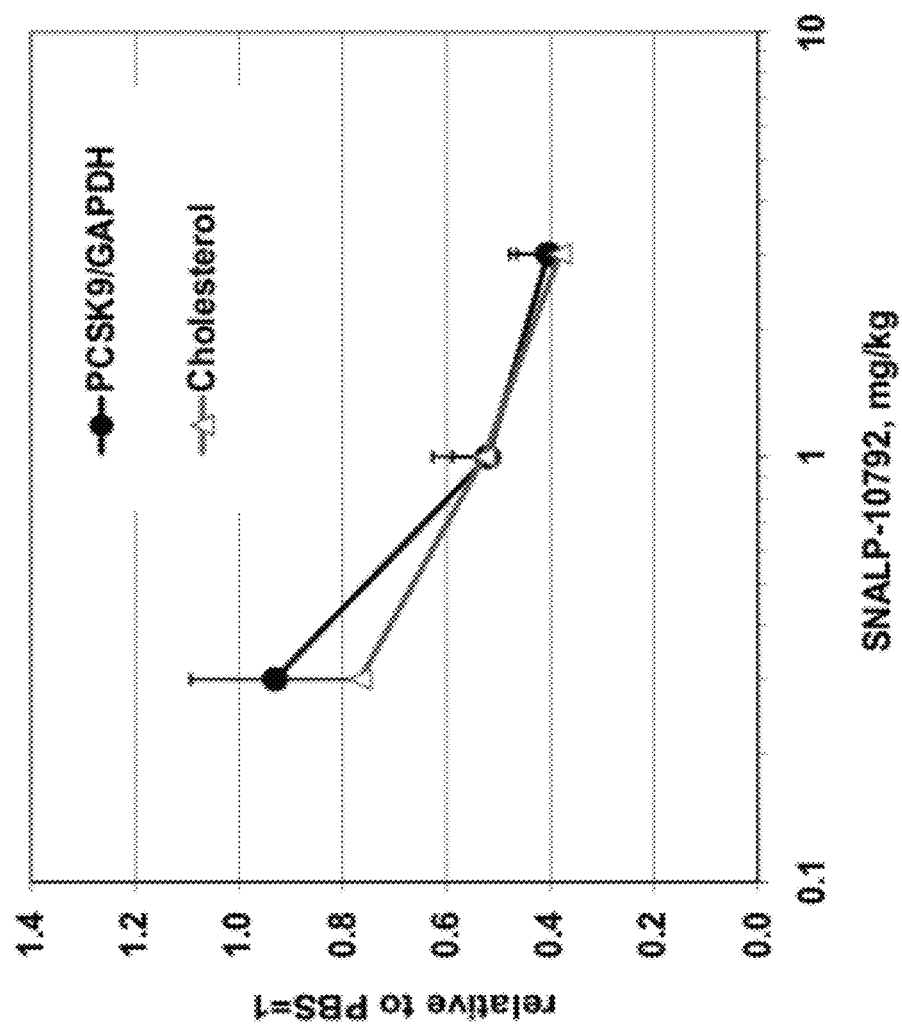
FIG. 19 is a graph showing the results of lipid formulated siRNAs on PCSK9 transcript levels and total serum cholesterol in rats.

Briefly, rats were dosed via tail injection with SNALP formulated siRNAs or PBS with a single dosage of about 0.3, 1.0, and 3.0 mg/kg of SNALP formulated AD-10792. Each dosage group included 5 rats. 72 hour post dosing rats were sacrificed and blood and liver samples were obtained, stored, and processed to determine PCSK9 mRNA and total serum cholesterol levels. The results are shown in FIG. 19. Compared to control PBS, SNALP formulated AD-10792 (FIG. 19A) had an ED50 of about 1.0 mg/kg for both lowering of PCSK9 transcript levels and total serum cholesterol levels. These results show that administration of SNALP formulated siRNA results in effective and efficient silencing of PCSK9 and subsequent lowering of total cholesterol in vivo.

Bolus Dosing

Bolus dosing of formulated siRNAs in Sprague-Dawley rats (5/group, 170-190 g body weight, Charles River Laboratories, MA) was performed by tail vein injection using a 27G needle. SiRNAs were formulated in SNALP (and then dialyzed against PBS) and diluted with PBS to concentrations 0.066; 0.2 and 0.6 mg/ml allowing the delivery of 0.3; 1.0 and 3.0 mg/kg of SNALP formulated AD-10792 in 5 µl/g body weight. Rats were kept under an infrared lamp for approximately 3 min prior to dosing to ease injection.

72 hour post last dose rats were sacrificed by CO2-asphyxiation. 0.2 ml blood was collected by retro-orbital bleeding and the liver was harvested and frozen in liquid nitrogen. Serum and livers were stored at −80° C. Frozen livers were grinded using 6850 Freezer/Mill Cryogenic Grinder (SPEX CentriPrep, Inc) and powders stored at −80° C. until analysis.

PCSK9 mRNA levels were detected using the branched-DNA technology based kit from QuantiGene Reagent System (Panomics, USA) according to the protocol. 10-20 mg of frozen liver powders was lysed in 600 µl of 0.16 µg/ml Proteinase K (Epicentre, #MPRK092) in Tissue and Cell Lysis Solution (Epicentre, #MTC096H) at 65° C. for 3 hours. Then 10 µl of the lysates were added to 90 µl of Lysis Working Reagent (1 volume of stock Lysis Mixture in two volumes of water) and incubated at 52° C. overnight on Genospectra capture plates with probe sets specific to rat PCSK9 and rat GAPDH. Probes sets for rat PCSK9 and rat GAPDH were purchased from Panomics, USA. Chemo luminescence was read on a Victor2-Light (Perkin Elmer) as Relative light units. The ratio of rat PCSK9 mRNA to rat GAPDH mRNA in liver lysates was averaged over each treatment group and compared to a control group treated with PBS or a control group treated with an unrelated siRNA (blood coagulation factor VII).

Total serum cholesterol in rat serum was measured using the Total Cholesterol Assay (Wako, USA) according to manufacturer's instructions. Measurements were taken on a Victor2 1420 Multilabel Counter (Perkin Elmer) at 600 nm.

Example 14

In Vitro Efficacy Screen in HeLa Cells of Mismatch Walk of AD-9680 and AD-14676

The effects of variations in sequence or modification on the effectiveness of AD-9680, AD-14676, and AD-10792 were assayed in HeLa cells. A number of variants were synthesized as shown in Table 6 and include adding DFT (2,4-Difluorotoluyl, a thymidine triphosphate shape analog lacking Watson-Crick pairing); adding single or combination mismatches; and testing two different backbone chemistries: leading with a 2'-O methyl, or alternating with 2'F.

Sequences of the 3 parent duplexes can be found in Table 1a and are duplicated as follows:

| target region | Sense strand (5' to 3') | SEQ ID NO: | Antisense strand (5'to 3') | SEQ ID NO: | Duplex |
|---|---|---|---|---|---|
| 3530-3548 | uucuAGAccuGuuuuGcuuTsT | 1229 | AAGcAAAAcAGGUCuAGAATsT | 1230 | AD-9680 |
| 3530-3548 | UfuCfuAfgAfcCfuGfuUfuUfg CfuUfTsT | 1231 | p-aAfgCfaAfaAfcAfgGfuCfuAfgA faTsT | 1232 | AD-14676 |
| 1091-1109 | GccuGGAGuuuAuucGGAATsT | 459 | UUCCGAAuAAACUCcAGGCTsT | 460 | AD-10792 |

HeLa were plated in 96-well plates (8,000-10,000 cells/well) in 100 µl 10% fetal bovine serum in Dulbecco's Modified Eagle Medium (DMEM). When the cells reached approximately 50% confluence (~24 hours later) they were transfected with serial four-fold dilutions of siRNA starting at 10 nM. 0.4 µl of transfection reagent Lipofectamine™ 2000 (Invitrogen Corporation, Carlsbad, Calif.) was used per well and transfections were performed according to the manufacturer's protocol. Namely, the siRNA: Lipofectamine™ 2000 complexes were prepared as follows. The appropriate amount of siRNA was diluted in Opti-MEM I Reduced Serum Medium without serum and mixed gently. The Lipofectamine™ 2000 was mixed gently before use, then for each well of a 96 well plate 0.4 µl was diluted in 25 µl of Opti-MEM I Reduced Serum Medium without serum and mixed gently and incubated for 5 minutes at room temperature. After the 5 minute incubation, 1 µl of the diluted siRNA was combined with the diluted Lipofectamine™ 2000 (total volume is 26.4 µl). The complex was mixed gently and incubated for 20 minutes at room temperature to allow the siRNA: Lipofectamine™ 2000 complexes to form. Then 100 µl of 10% fetal bovine serum in DMEM was added to each of the siRNA:Lipofectamine™ 2000 complexes and mixed gently by rocking the plate back and forth. 100 µl of the above mixture was added to each well containing the cells and the plates were incubated at 37° C. in a CO2 incubator for 24 hours, then the culture medium was removed and 100 µl 10% fetal bovine serum in DMEM was added.

24 hours post medium change medium was removed, cells were lysed and cell lysates assayed for PCSK9 mRNA silencing by bDNA assay (Panomics, USA) following the manufacturer's protocol. Chemo luminescence was read on a Victor2-Light (Perkin Elmer) as Relative light units. The ratio of human PCSK9 mRNA to human GAPDH mRNA in cell lysates was compared to that of cells treated with Lipofectamine™ 2000 only control.

Figure 20:
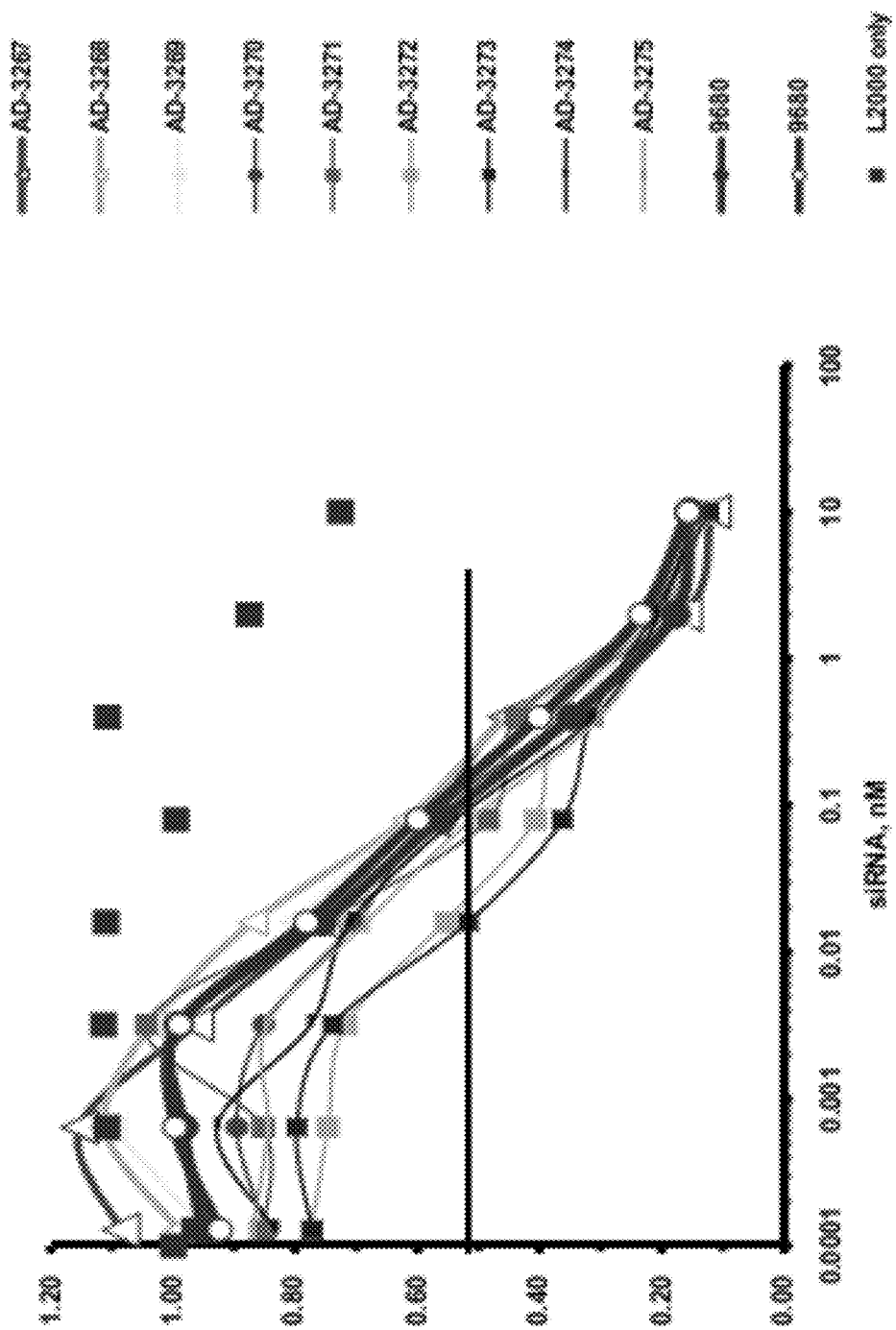
FIG. 20 is a graph showing the results of siRNA transfection on PCSK9 transcript levels in HeLa cells using AD-9680 and variations of AD-9680 as described in Table 6.
Figure 21:
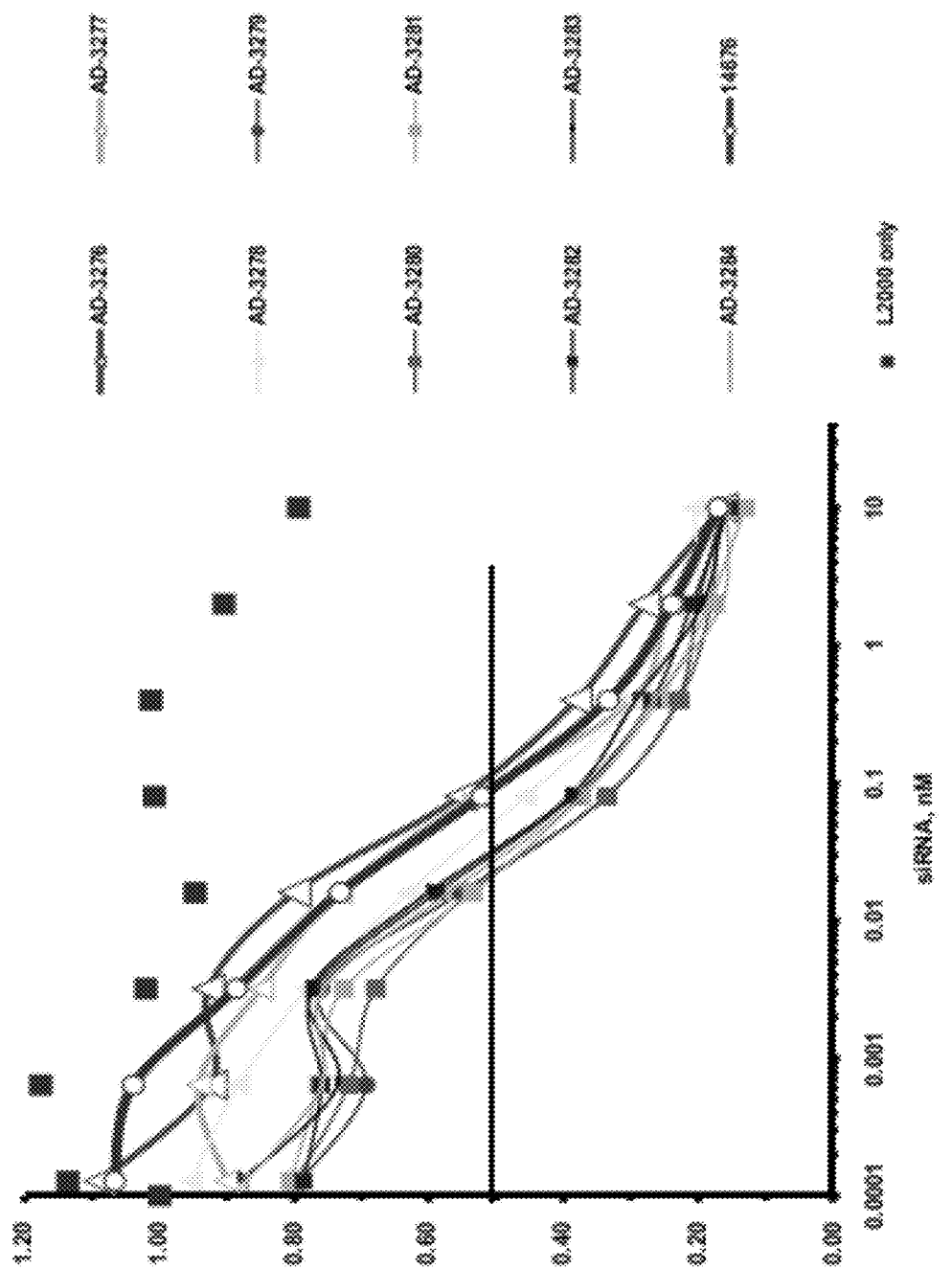
FIG. 21 is a graph showing the results of siRNA transfection on PCSK9 transcript levels in HeLa cells using AD-14676 and variations of AD-14676 as described in Table 6.
Figure 24:
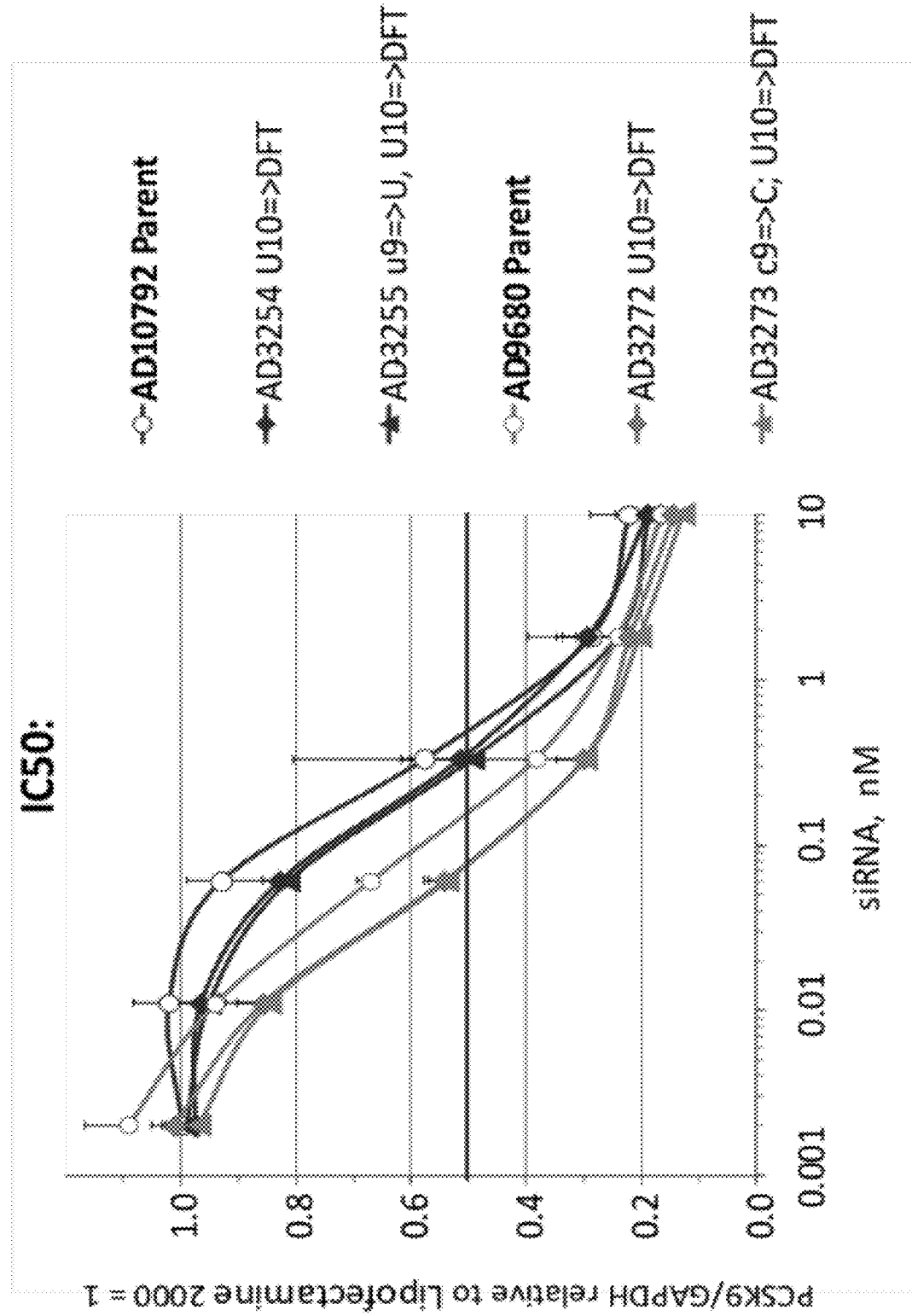
FIG. 24 is a dose response curve of treatment of HeLa cells with modified siRNAs.

FIG. 20 is dose response curves of a series of compounds related to AD-9680. FIG. 21 is a dose response curve of a series of compounds related to AD-14676 The results show that DFTs or mismatches in certain positions are able increase the activity (as evidenced by lower IC50 values) of both parent compounds. FIG. 24 is a dose response curve comparing the efficiency of parent duplexes AD-9680 and AD-10792 with modified duplexes wherein a DFT is inserted at position 10 of the sense strand. This modification improves the efficiency by about 2 fold in HeLa cells.

Without being bound by theory, it is hypothesized that destabilization of the sense strand through the introduction of mismatches, or DFT might result in quicker removal of the sense strand.

Example 15

Lack of Off Target Effects in Hep3B Cells at High Concentrations

A lipid formulated PCSK9 targeted siRNA (AD-9680) was transfected into Hep3B cells at concentrations of 250 nM, 1 uM and 5 uM in triplicates using the reagent RNAiMAX (Invitrogen) according to the manufacture's instruction: 1 ul of transfection reagent; reverse transfection protocol. Samples were collected 48 hrs post transfection. Total RNA was purified using MagMAX™-96 Total RNA Isolation Kit (Ambion); cDNA was synthesized with High Capacity cDNA Reverse Transcription Kit with RNase Inhibitor (ABI) from 13.5 µl of RNA prep; ABI Gene Expression Taqman assays were used; q-PCR reactions were set up according to manufacturer's instruction using TaqMan® Gene Expression Master Mix (ABI) and run on ABI 7900 machine. Delta delta Ct method was used to calculate values. Samples were normalized to hGAPDH and calibrated to mock transfection.

Transcript levels were measured for the following genes having the closest homology to the target sequence: ORMDL2, BMP6, TAPT1, MYEF2, LOC442252, RFT1, and PCSK9.

Figure 22:
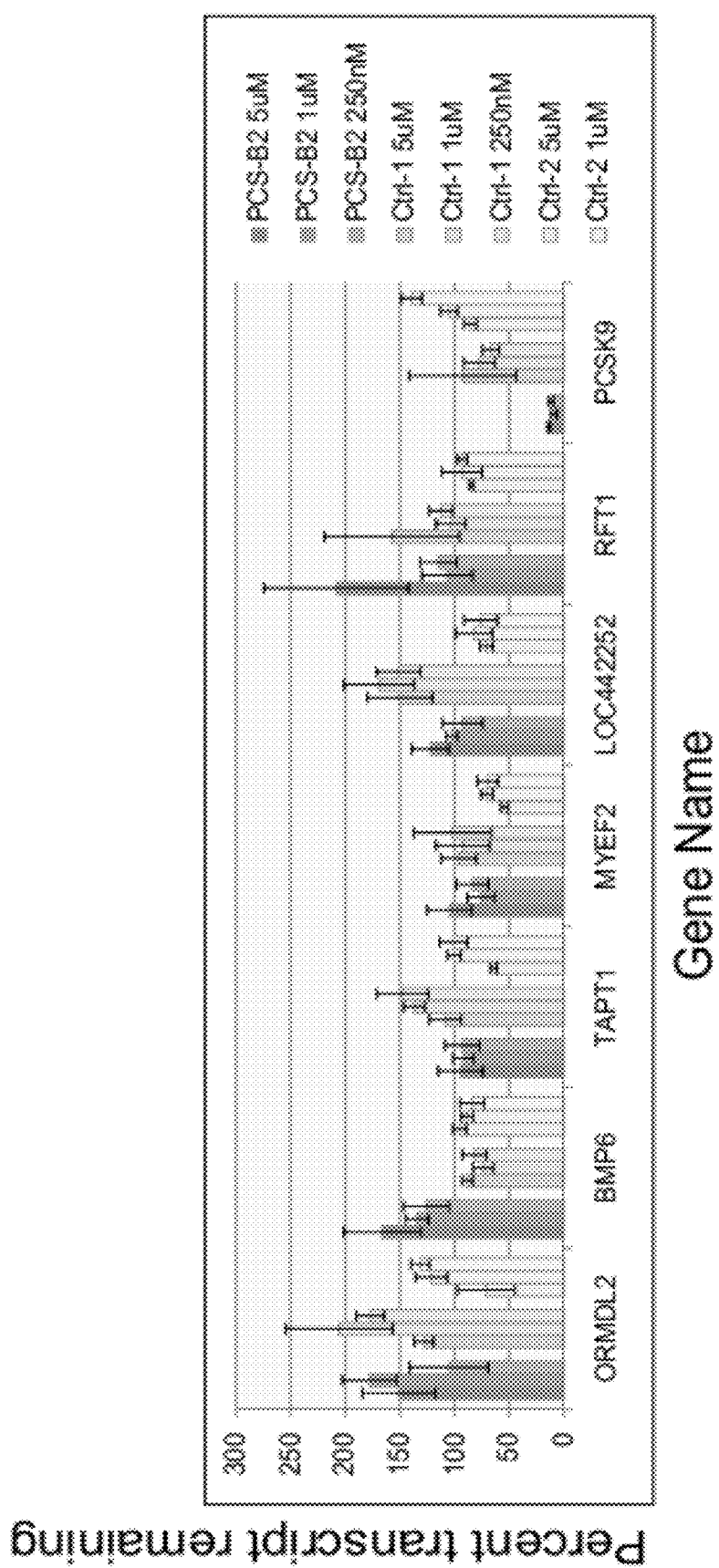
FIG. 22 is a graph with the results of PCSK9 targeted siRNA transfection of Hep3B cells and the effects on PCSK9 and off-target gene levels.

The results are shown in FIG. 22. No off target effects were observed at high concentrations of dsRNA (PCS-B2=AD-9680).

```
AD-9680   S    1531   uucuAGAccuGuuuuGcuudTsdT
          AS   1532   AAGcAAAAcAGGUCuAGAAdTsdT
```

Example 16

Maintenance of Decrease in Total Cholesterol Levels in Rats by Lower Dosage of AD-10792

Rats were treated with 3 mg/kg bolus dose of SNALP-Dlin DMA formulated AD-10792. At day 2, total serum cholesterol levels were determined. This was followed by once a week dosing at 1.0 and 0.3 mg/kg for four weeks. Rats were bled one day prior to repeat dosing and total serum cholesterol levels were determined. The negative control was PBS.

Figure 23:
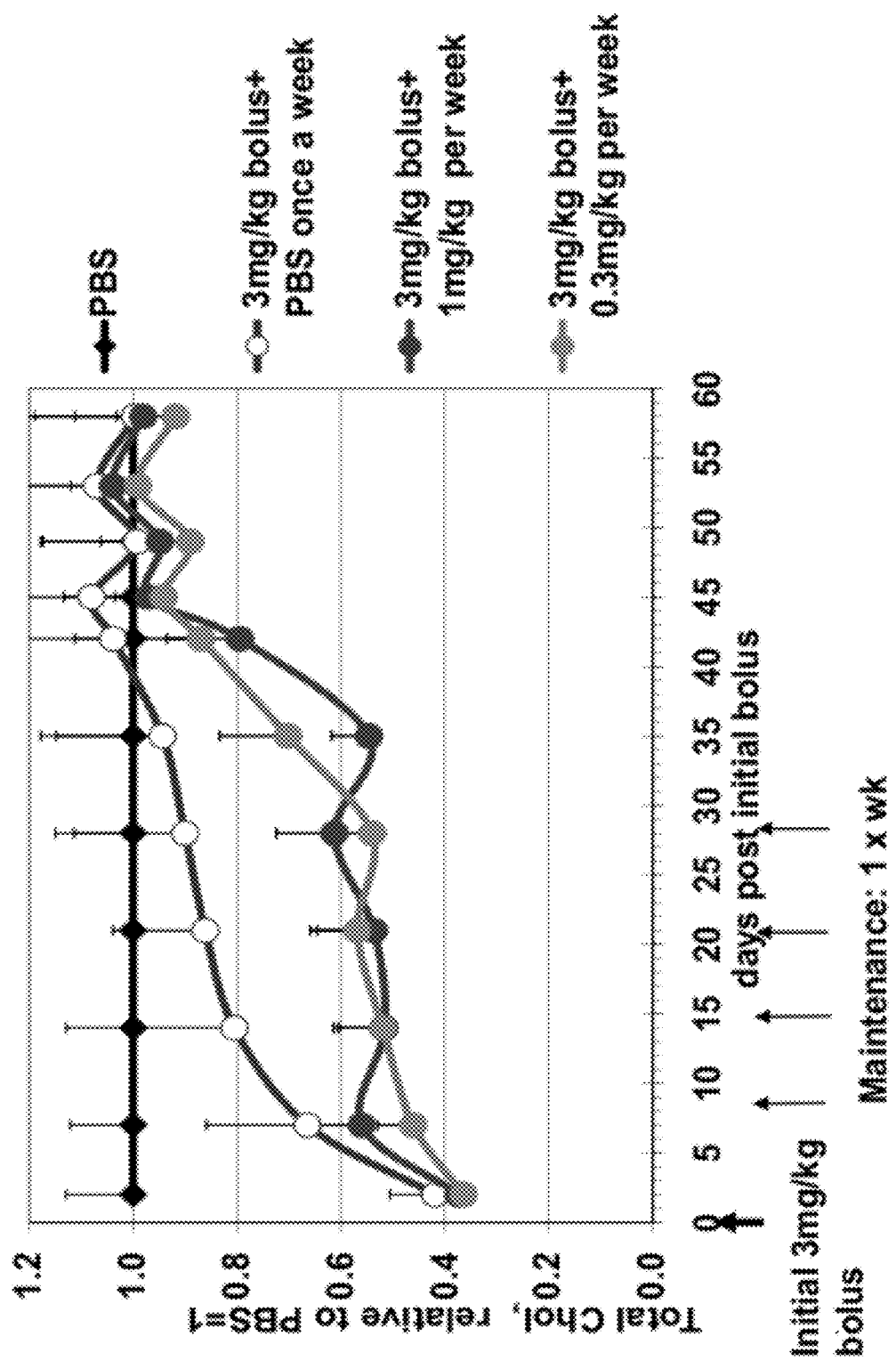
FIG. 23 shows the results of treatment in rats with a maintenance dose of PCSK9 targeted siRNA.

The results are shown in the graph of FIG. 23. After 3 mg/kg bolus dose, total cholesterol levels decreased by 60% and were maintained at about 50% by repeated once a week 1.0 and 0.3 mg/kg dosing and come back to pre dose levels after repeated dosing is stopped.

A 10 fold lower (than EC50), once a week, maintenance dose effectively maintains silencing with cholesterol levels returning to baseline by 15 days post last injection. The initial does of PCSK9 increased LDLR levels as reflected by the decrease in total serum cholesterol. This increase in LDLR levels increased the efficacy of the PCSK9 targeted siRNA as reflected by the lower dosage of subsequent administration AD-10792.

Example 17

Assay of Effects on Cholesterol Levels in Rats after Administration of Various Lipid Formulations of AD-10792

Rats were treated with four different lipid formulations of AD-10792 including SNALP and LNP08, described herein. At day 3, total serum cholesterol levels were determined. The experiment was performed using the methods described herein. Administration of LNP-08 formulated AD-10792 results in the lowest EC50 of 0.08 mg/kg compared to LNP01 formulated (EC50 of 2.0 mg/kg) and SNALP formulated (EC50 of 1.0 mg/kg). (data not shown).

Example 18

PCSK9 siRNA Tiling Experiment

Bioinformatic Selection of PCSK9 Tiling Set

Sense and antisense oligomers were designed to target the human PCSK9 transcript in the flanking regions immediately upstream and downstream of the 19 base target region of ALN-PCSK9 (AD-9680). We used the NCBI Refseq NM_174936.2 as the reference human transcript for the PCSK9 gene. The antisense oligo of AD-9680 contains 19 contiguous bases complementary to the bases in the region of NM_174936 from positions 3530 through 3548 relative to the start of the mRNA. A set of siRNA molecules was designed to each unique 19mer of the subset of the transcript sequence defined by 10 bases upstream from the 5' end to 10 bases downstream from the 3' end of the target region of AD-9680. With respect to the NM_174936.2 transcript, the first base at the 5' position of the sense oligo 19mer extends from positions 3520 to positions 3558 (Tables 7 and 8).

Synthesis of PCSK9 Tiling Sequences:

PCSK9 sequences were synthesized on MerMade 192 synthesizer. Two sets of sequences were made. The first set contained no chemical modifications (unmodified) and a second set was made with endolight chemical modifications. In sequences containing endolight chemical modification, all pyrimidines (cytosine and uridine) in the sense strand were replaced with corresponding 2'-O-Methyl bases (2' O-Methyl C and 2'-O-Methyl U). In the antisense strand, pyrimidines adjacent to (towards 5' position) ribo A nucleoside were replaced with their corresponding 2-O-Methyl nucleosides. A two base dTsdT extension at the 3' end of both sense and anti sense sequences was introduced. The sequence file was converted to a text file to make it compatible for loading in the MerMade 192 synthesis software.

The synthesis of PCSK9 sequences used solid supported oligonucleotide synthesis using phosphoramidite chemistry. The synthesis of the above sequences was performed at 1 µm scale in 96 well plates. The amidite solutions were prepared at 0.1 M concentration and ethyl thio tetrazole (0.6M in Acetonitrile) was used as activator. The synthesized sequences were cleaved and deprotected in 96 well plates, using methylamine in the first step and Fluoride ion in the second step. The crude sequences thus obtained were precipitated using acetone:ethanol mix and the pellet were re-suspended in 0.2M sodium acetate buffer. Samples from each sequence were analyzed by LC-MS and the resulting mass data confirmed the identity of the sequences. A selected set of samples were also analyzed by IEX chromatography. All sequences were purified on AKTA explorer purification system using Source 15Q column. A single peak corresponding to the full length sequence was collected in the eluent and was subsequently analyzed for purity by ion exchange chromatography. The purified sequences were desalted on a Sephadex G25 column using AKTA purifier. The desalted PCSK9 sequences were analyzed for concentration and purity. The single strands were then submitted for annealing.

In Vitro Screening of PCSK9 Tiling siRNAs:

Cell Culture and Transfection:

Hela cells (ATCC, Manassas, Va.) were grown to near confluence at 37° C. in an atmosphere of 5% CO2 in Eagle's Minimum Essential Medium (EMEM, ATCC) supplemented with 10% FBS, streptomycin, and glutamine (ATCC) before being released from the plate by trypsinization. Reverse transfection was carried out by adding 5 µl of Opti-MEM to 5 µl of siRNA duplexes per well into a 96-well plate along with 10 µl of Opti-MEM plus 0.2 µl of Lipofectamine RNAiMax per well (Invitrogen, Carlsbad Calif. cat #13778-150) and incubated at room temperature for 15 minutes. 80 µl of complete growth media without antibiotic containing $2.0 \times 10^4$ Hela cells were then added. Cells were incubated for 24 hours prior to RNA purification. Experiments were performed at 0.1 or 10 nM final duplex concentration. For dose response screens, HeLa cells were transfected with siRNAs over seven, ten-fold serial dilutions from 1 nM to 1 fM.

Total RNA was isolated using MagMAX-96 Total RNA Isolation Kit (Applied Biosystem, Forer City Calif., part #: AM1830). Cells were harvested and lysed in 140 µl of Lysis/Binding Solution then mixed for 1 minute at 850 rpm using and Eppendorf Thermomixer (the mixing speed was the same throughout the process). Twenty micro liters of magnetic beads and Lysis/Binding Enhancer mixture were added into cell-lysate and mixed for 5 minutes. Magnetic beads were captured using magnetic stand and the supernatant was removed without disturbing the beads. After removing supernatant, magnetic beads were washed with Wash Solution 1 (isopropanol added) and mixed for 1 minute. Beads were capture again and supernatant removed. Beads were then washed with 150 µl Wash Solution 2 (Ethanol added), captured and supernatant was removed. 50 µl of DNase mixture (MagMax turbo DNase Buffer and Turbo DNase) was then added to the beads and they were mixed for 10 to 15 minutes. After mixing, 100 µl of RNA Rebinding Solution was added and mixed for 3 minutes. Supernatant was removed and magnetic beads were washed again with 150 µl Wash Solution 2 and mixed for 1 minute and supernatant was removed completely. The magnetic beads were mixed for 2 minutes to dry before RNA was eluted with 50 µl of water.

cDNA was synthesized using ABI High capacity cDNA reverse transcription kit (Applied Biosystems, Foster City, Calif., Cat #4368813). A master mix of 2 µl 10× Buffer, 0.8 µl 25× dNTPs, 2 µl Random primers, 1 µl Reverse Transcriptase, 1 µl RNase inhibitor and 3.2 µl of H2O per reaction were added into 10 µl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real time PCR was performed as follows. 2 µl of cDNA were added to a master mix containing 1 µl GAPDH TaqMan Probe (Applied Biosystems Cat #4326317E), 1 µl PCSK9 TaqMan probe (Applied Biosystems cat #HS03037355_M1) and 10 µl Roche Probes Master Mix (Roche Cat #04887301001) per well in a LightCycler 480 384 well plate (Roche cat #0472974001). Real time PCR was done in a LightCycler 480 Real Time PCR machine (Roche). Each duplex was tested in two independent transfections and each transfections was assayed in duplicate.

Real time data were analyzed using the ΔΔ Ct method. Each sample was normalized to GAPDH expression and knockdown was assessed relative to cells transfected with the non-targeting duplex AD-1955. IC50s were defined using a 4 parameter fit model in XLfit.

The data for the single dose experiments are shown in Table 9. Data are expressed as the percent of message remaining relative to cells targeted with control AD-1955.

The data for the dose response screen is shown in Table 10. Data are expressed as dose in pM that results in 50% inhibition relative to AD-1955. Each dose response was repeated twice (Rep1 and Rep2). Average of the IC50s generated in the two dose response screens is shown.

Figure 25:
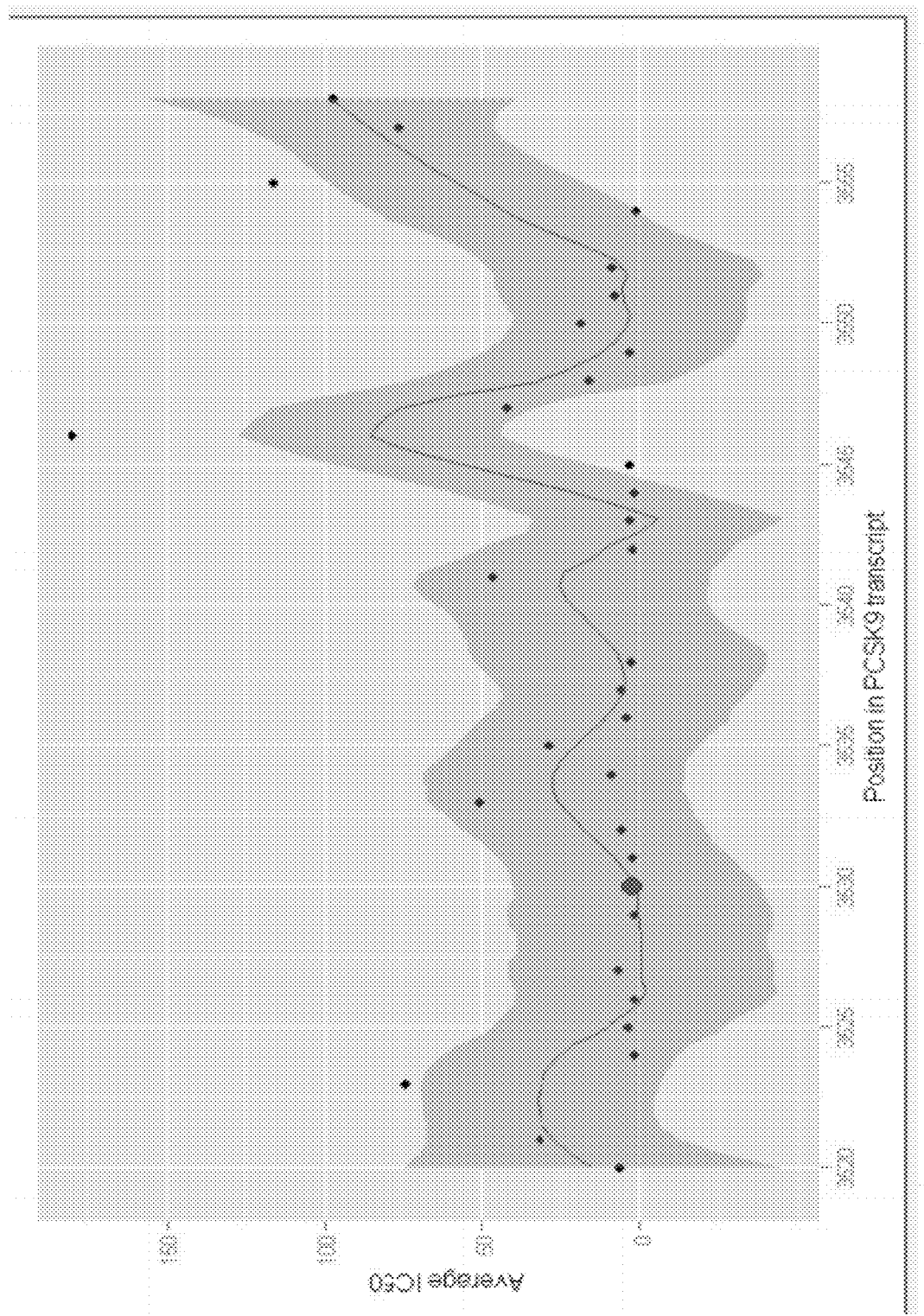
FIG. 25 is a graph of average IC50 of siRNA vs. target position in human PCSK9 transcript. The large blue dot indicates the IC50 and location of AD-9680.

The average IC50 for siRNA flanking AD-9680 was plotted vs. the starting position of the target region in the human PCSK9 transcript FIG. 25.

Thus, targeting nucleotide region 3520-3555 of PCSK9 with an RNAi agent is highly effective at inhibiting PCSK9.

Example 19

ApoE3-Based Reconstituted HDL Complexed with dsRNAs Targeting PCSK9

C57BL6 mice were administered 30 mg/kg rEHDL/chol-siPCSK9 by intravenous administration (tail vein injection) in a single bolus dose.

Chol-siPCSK9 (dsRNA Duplex AD-20583) has the following sequence:

```
                                        (SEQ ID NO: 1729)
Sense:     GccuGGAGuuuAuucGGAAdTsdTL10

(SEQ ID NO: 1730)
Antisense: PuUfcCfgAfaUfaAfaCfuCfcAfgGfcdTsdT
```

The structure of L10 is:

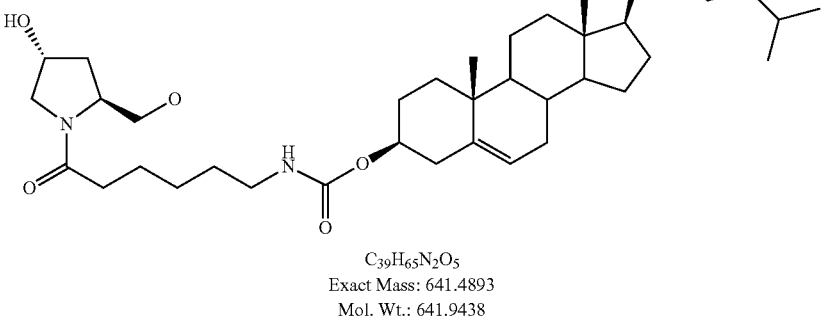

$C_{39}H_{65}N_2O_5$
Exact Mass: 641.4893
Mol. Wt.: 641.9438

After injection, mice were fasted overnight (~14 hours), and then sacrificed at 48 h post-injection. mRNA levels from liver were determined by bDNA assay, and normalized to GAPDH mRNA levels.

Results

Figure 26:
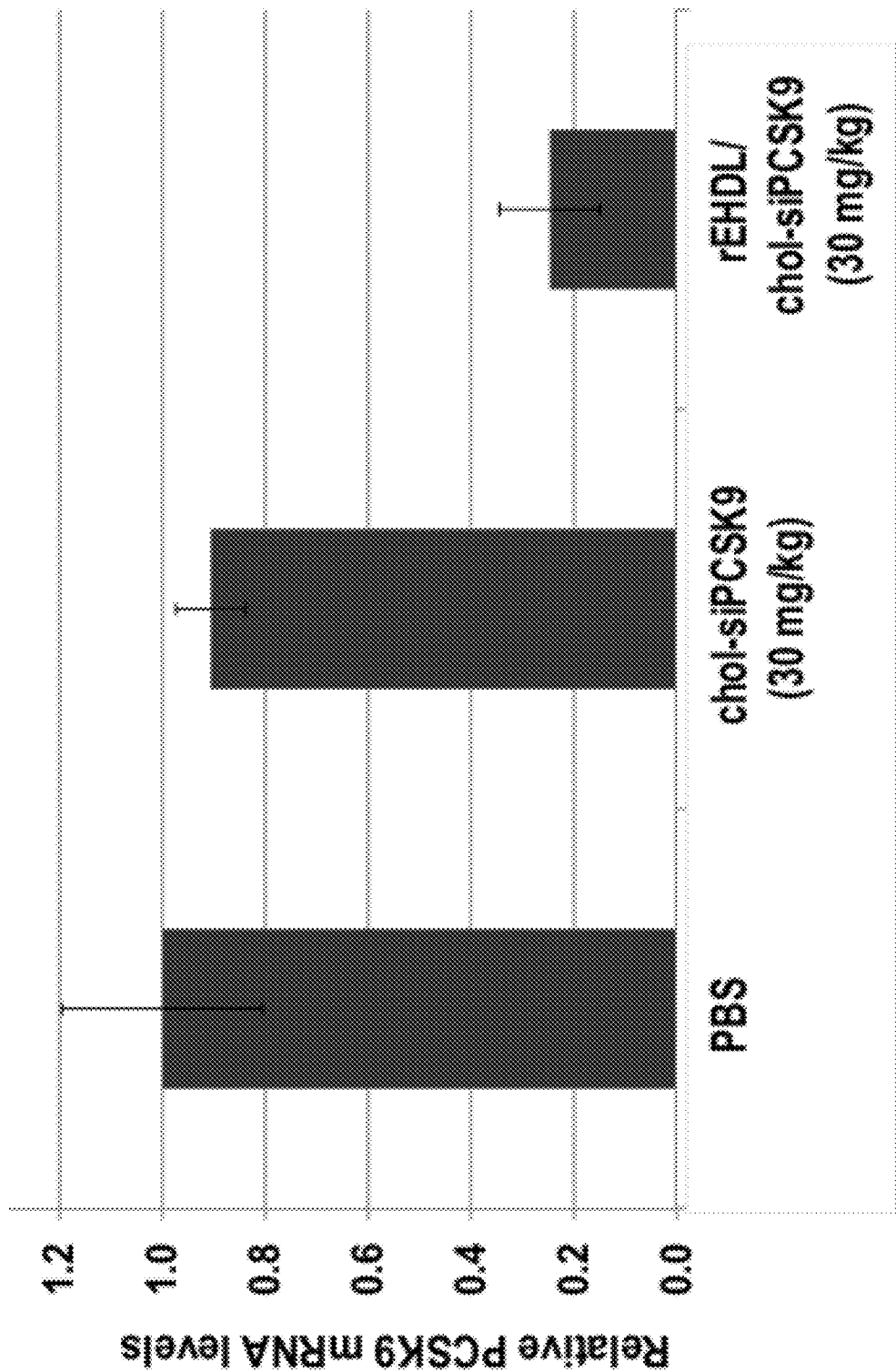
FIG. 26 is a graph with the results of administration of rEHDL formulated cholesterol conjugated siRNA.

The results of the bDNA assays are shown in FIG. 26, which indicate that there was a significant reduction in PCSK9 following administration of rEHDL/chol-siPCSK9, but not following administration of uncomplexed siRNAs (chol-siPCSK9). rEHDL/chol-siPCSK9 decreased PCSK9 mRNA levels by about 80%.

Example 20

LNP-11 Formulated siRNA in Non-Human Primates (NHPs)

An siRNA targeting PCSK9 (AD-9680) was formulated in a LNP-11 formulation (described herein) and administered to cynomologous monkeys. Control was AD-1955. The lipid formulated siRNAs were administered via a 30 minute infusion on day 1 at dosages of 0.03, 0.1, 0.3, and 1.0 mg/kg.

Control was administered at 1.0 mg/kg. On day 3, liver biopsies were performed for measurement of PCSK9 transcript. Blood samples were collected on days −3, −1, 3, 4, 5, 7, 9, 11, 12, 15, 22, 30, and 37 and PCSK9 protein levels and LDLc numbers and HDLc numbers were determined.

Figure 27A:
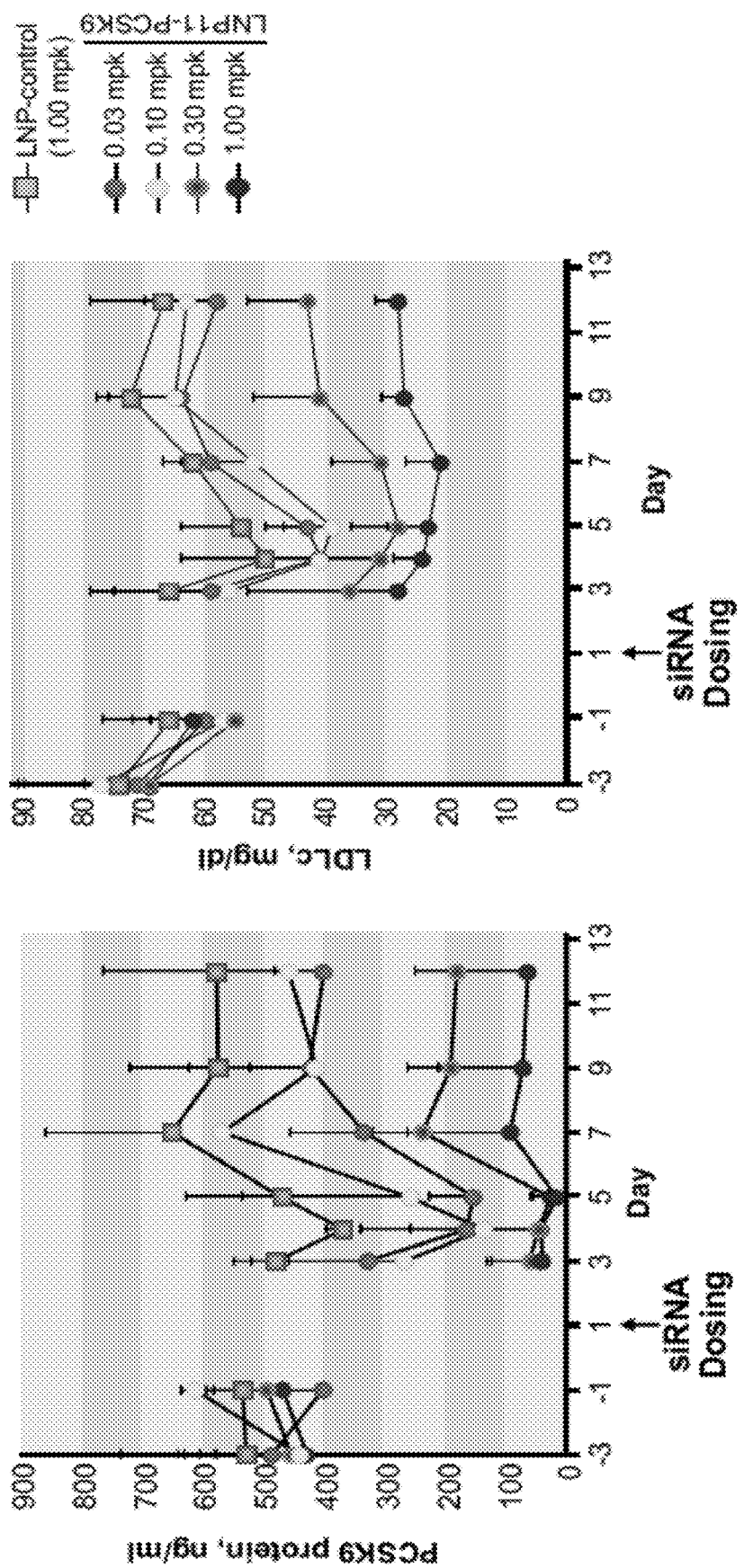
FIG. 27A is a graph with results of administration of second generation LNP formulated PCSK9 targeted siRNA (AD-9680 in LNP11) to non-human primates, demonstrating a reduction in both PCSK9 protein and LDLc levels. LDLc: low density lipoprotein cholesterol; mpk: mg per kg.
Figure 27B:
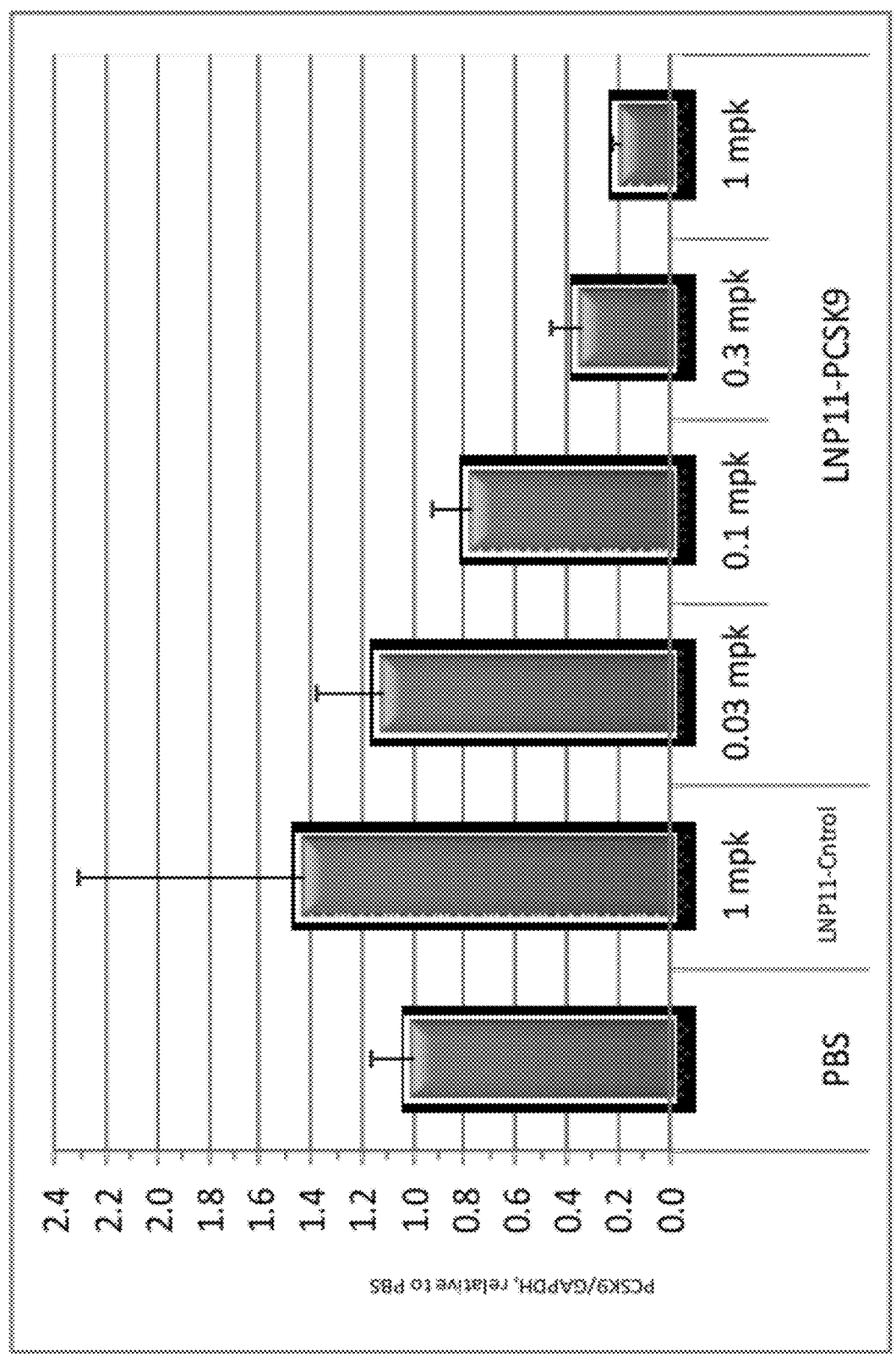
FIG. 27B is a bar graph showing dose dependent PCSK mRNA silencing in non-human primates after treatment with LNP formulated siRNA targeting PCSK9.

The results are shown in FIG. 27A, FIG. 27B, and FIG. 27C.

As shown in FIG. 27A and FIG. 27B, administration resulted in a rapid and durable dose dependent reduction in PCSK9 protein levels and resulted in >50% reduction in LDLc (LDL cholesterol) levels. These effects were very potent with ED50 dose levels between 30 and 100 micrograms per kilogram. As shown in FIG. 27C, administration resulted in no change in HDLc levels.

Example 21

Dose Response in Rats with LNP-09 Formulated PCSK9 dsRNA

The dsRNA AD-10792 (targeting rate PCSK9) was encapsulated in a XTC containing formulation, e.g., a LNP09 formulation. LNP09 formulation was XTC/DSPC/Cholesterol/PEG-DMG at a % mol ratio of 50/10/38.5/1.5 and a lipid:siRNA ratio of 10:1.

Formulations were injected via tail vein, single dose (DRC) into rats. Livers and plasma were harvested 72 hours post-injection (5 animals per group). PCSK9 transcript levels were measured via bDNA in livers prepared as manufacturer's protocol. GAPDH transcript levels were also measured and the PCSK9 to GAPDH ratios were normalized to those of PBS control and graphed. Total cholesterol was measured in serum using cholesterol kit from WAKO TX.

Figure 29:
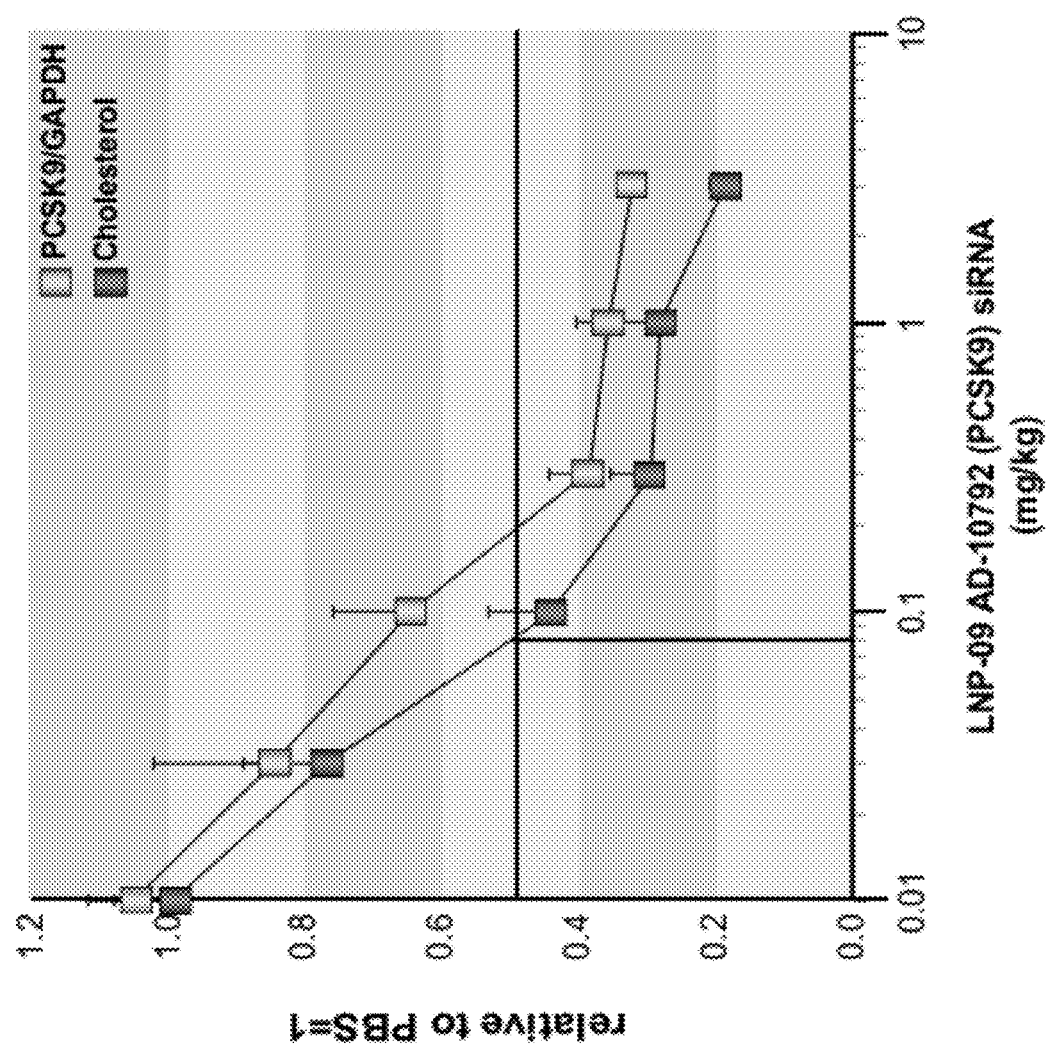
FIG. 29 is a graph of effects on PCSK9 mRNA and serum cholesterol levels in rats after administration of LNP-09 formulated AD-10792, an siRNA targeting rodent PCSK9.

The results are shown in FIG. 29. With this formulation PCSK9 silencing and total cholesterol lowering in rats was achieved at doses <0.1 mg/kg. The $ED_{50}$ for was 0.2 mg/kg for lowering PCSK9 mRNA and 0.2 mg/kg and 0.08 for lowering serum cholesterol.

Example 22

Treatment of Transgenic Mice with LNP-09 Formulated PCSK9 dsRNA

Transgenic mice that overexpress human CETP and ApoB 100 (CETP/ApoB double humanized transgenic mice, Taconic Labs) more closely mimic the LDL/HDL ratios found in man.

CETP/ApoB double humanized transgenic mice were purchased from Taconic labs. Animals were injected through tail vein (single injection) of 5 mg/kg of LNP09 formulated AD-10792 (standard formulation procedure), or AD-1955 Luciferase control (4 animals per group). Livers and plasma were harvested 72 hours post-injection (5 animals per group) and liver PCSK9 mRNA, LDL particle, and HDL particle number were determined.

PCSK9 transcript levels were measured via bDNA in livers prepared according to manufacturer's protocol. GAPDH transcript levels were also measured and the PCSK9 to GAPDH ratios were graphed, normalized to those of PBS control. LDL and HDL particle numbers/concentration were measured by NMR (Liposciences Inc.) based on their SOP.

Figure 30:
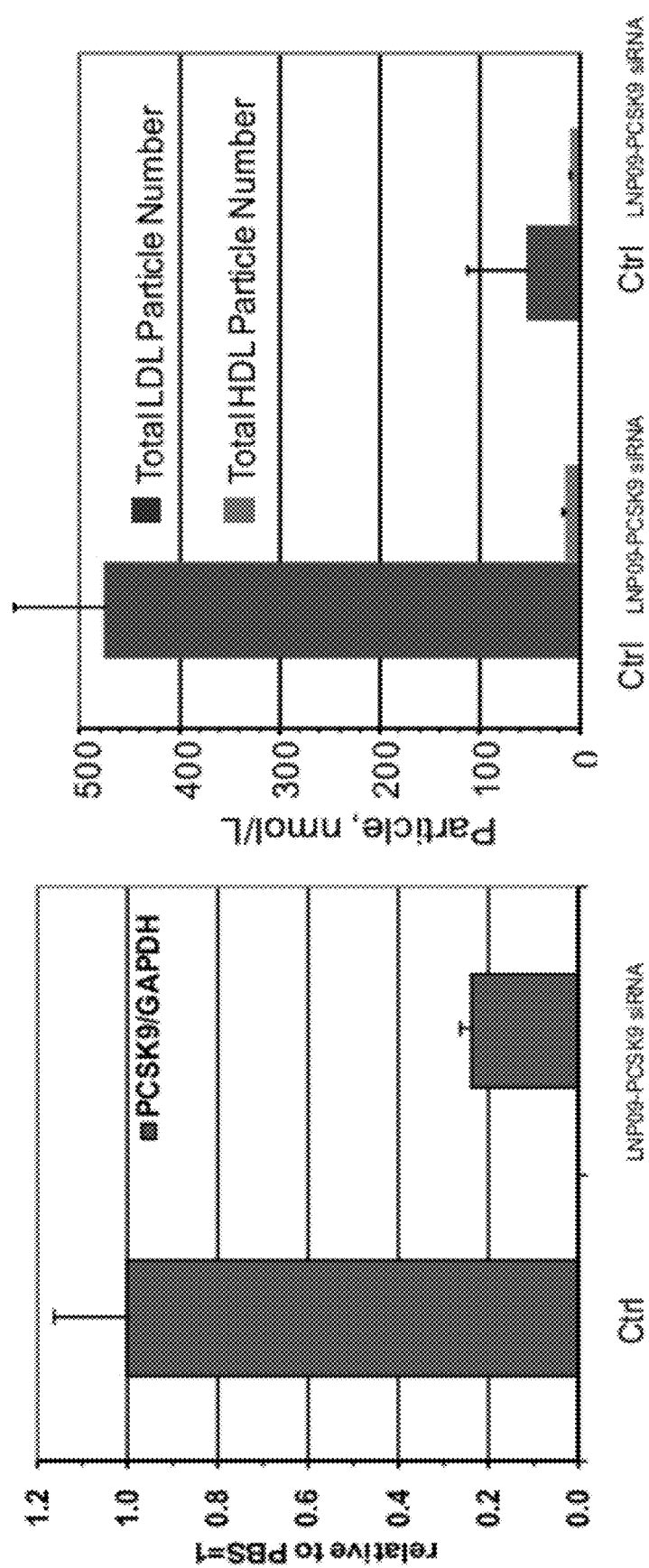
FIG. 30 are graphs of the effects on PCSK9 mRNA and LDL/HDL particle numbers in CETP/ApoB tg mice after administration of LNP-09 formulated AD-10792, an siRNA targeting rodent PCSK9.

The results are shown in FIG. 30. Silencing of PCSK9 lowered LDL particle concentrations ~90%, while HDL levels were modestly lower (as compared to those treated animals treated with PBS controls). This demonstrates significant lowering of PCSK9 levels with subsequent LDLc lowering in these animals.

Example 23

Inhibition of PCSK9 Expression in Humans

A human subject is treated with a lipid formulated dsRNA targeted to a PCSK9 gene, described herein, to inhibit expression of the PCSK9 gene and lower cholesterol levels for an extended period of time following a single dose. In one embodiment, the lipid formulated dsRNA includes the lipid MC3.

A subject in need of treatment is selected or identified. The subject can be in need of LDL lowering, LDL lowering without lowering of HDL, ApoB lowering, or total cholesterol lowering. The identification of the subject can occur in a clinical setting, or elsewhere, e.g., in the subject's home through the subject's own use of a self-testing kit.

At time zero, a suitable first dose of an anti-PCSK9 siRNA is subcutaneously administered to the subject. The dsRNA is formulated as described herein. After a period of time following the first dose, e.g., 7 days, 14 days, and 21 days, the subject's condition is evaluated, e.g., by measuring LDL, ApoB, and/or total cholesterol levels. This measurement can be accompanied by a measurement of PCSK9 expression in said subject, and/or the products of the successful siRNA-targeting of PCSK9 mRNA. Other relevant criteria can also be measured. The number and strength of doses are adjusted according to the subject's needs.

After treatment, the subject's LDL, ApoB, or total cholesterol levels are lowered relative to the levels existing prior to the treatment, or relative to the levels measured in a similarly afflicted but untreated subject.

Those skilled in the art are familiar with methods and compositions in addition to those specifically set out in the present disclosure which will allow them to practice this invention to the full scope of the claims hereinafter appended.

TABLE 1a dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2-20 | AGCGACGUCGAGGCGCUCAUU | 1 | UGAGCGCCUCGACGUCGCUTT | 2 | AD-15220 |
| 15-33 | CGCUCAUGGUUGCAGGCGGUU | 3 | CCGCCUGCAACCAUGAGCGUU | 4 | AD-15275 |
| 16-34 | GCUCAUGGUUGCAGGCGGGUU | 5 | CCCGCCUGCAACCAUGAGCUU | 6 | AD- |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| | | | | | 15301 |
| 30-48 | GCGGGCGCCGCCGUUCAGUTT | 7 | ACUGAACGGCGGCGCCCGCTT | 8 | AD-15276 |
| 31-49 | CGGGCGCCGCCGUUCAGUUTT | 9 | AACUGAACGGCGGCGCCCGTT | 10 | AD-15302 |
| 32-50 | GGGCGCCGCCGUUCAGUUCTT | 11 | GAACUGAACGGCGGCGCCCTT | 12 | AD-15303 |
| 40-58 | CCGUUCAGUUCAGGGUCUGTT | 13 | CAGACCCUGAACUGAACGGTT | 14 | AD-15221 |
| 43-61 | UUCAGUUCAGGGUCUGAGCTT | 15 | GCUCAGACCCUGAACUGAATT | 16 | AD-15413 |
| 82-100 | GUGAGACUGGCUCGGGCGGTT | 17 | CCGCCCGAGCCAGUCUCACTT | 18 | AD-15304 |
| 100-118 | GGCCGGGACGCGUCGUUGCTT | 19 | GCAACGACGCGUCCCGGCCTT | 20 | AD-15305 |
| 101-119 | GCCGGGACGCGUCGUUGCATT | 21 | UGCAACGACGCGUCCCGGCTT | 22 | AD-15306 |
| 102-120 | CCGGGACGCGUCGUUGCAGTT | 23 | CUGCAACGACGCGUCCCGGTT | 24 | AD-15307 |
| 105-123 | GGACGCGUCGUUGCAGCAGTT | 25 | CUGCUGCAACGACGCGUCCTT | 26 | AD-15277 |
| 135-153 | UCCCAGCCAGGAUUCCGCGTsT | 27 | CGCGGAAUCCUGGCUGGGATsT | 28 | AD-9526 |
| 135-153 | ucccAGccAGGAuuccGcGTsT | 29 | CGCGGAAUCCUGGCUGGGATsT | 30 | AD-9652 |
| 136-154 | CCCAGCCAGGAUUCCGCGCTsT | 31 | GCGCGGAAUCCUGGCUGGGTsT | 32 | AD-9519 |
| 136-154 | cccAGccAGGAuuccGcGcTsT | 33 | GCGCGGAAUCCUGGCUGGGTsT | 34 | AD-9645 |
| 138-156 | CAGCCAGGAUUCCGCGCGCTsT | 35 | GCGCGCGGAAUCCUGGCUGTsT | 36 | AD-9523 |
| 138-156 | cAGccAGGAuuccGcGcGcTsT | 37 | GCGCGCGGAAUCCUGGCUGTsT | 38 | AD-9649 |
| 185-203 | AGCUCCUGCACAGUCCUCCTsT | 39 | GGAGGACUGUGCAGGAGCUTsT | 40 | AD-9569 |
| 185-203 | AGcuccuGcAcAGuccuccTsT | 41 | GGAGGACUGUGcAGGAGCUTsT | 42 | AD-9695 |
| 205-223 | CACCGCAAGGCUCAAGGCGTT | 43 | CGCCUUGAGCCUUGCGGUGTT | 44 | AD-15222 |
| 208-226 | CGCAAGGCUCAAGGCGCCGTT | 45 | CGGCGCCUUGAGCCUUGCGTT | 46 | AD-15278 |
| 210-228 | CAAGGCUCAAGGCGCCGCCTT | 47 | GGCGGCGCCUUGAGCCUUGTT | 48 | AD-15178 |
| 232-250 | GUGGACCGCGCACGGCCUCTT | 49 | GAGGCCGUGCGCGGUCCACTT | 50 | AD-15308 |
| 233-251 | UGGACCGCGCACGGCCUCUTT | 51 | AGAGGCCGUGCGCGGUCCATT | 52 | AD-15223 |
| 234-252 | GGACCGCGCACGGCCUCUATT | 53 | UAGAGGCCGUGCGCGGUCCTT | 54 | AD-15309 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 235-253 | GACCGCGCACGGCCUCUAGUTT | 55 | CUAGAGGCCGUGCGCGGUCTT | 56 | AD-15279 |
| 236-254 | ACCGCGCACGGCCUCUAGGTT | 57 | CCUAGAGGCCGUGCGCGGUTT | 58 | AD-15194 |
| 237-255 | CCGCGCACGGCCUCUAGGUTT | 59 | ACCUAGAGGCCGUGCGCGGTT | 60 | AD-15310 |
| 238-256 | CGCGCACGGCCUCUAGGUCTT | 61 | GACCUAGAGGCCGUGCGCGTT | 62 | AD-15311 |
| 239-257 | GCGCACGGCCUCUAGGUCUTT | 63 | AGACCUAGAGGCCGUGCGCTT | 64 | AD-15392 |
| 240-258 | CGCACGGCCUCUAGGUCUCTT | 65 | GAGACCUAGAGGCCGUGCGTT | 66 | AD-15312 |
| 248-266 | CUCUAGGUCUCCUCGCCAGTT | 67 | CUGGCGAGGAGACCUAGAGTT | 68 | AD-15313 |
| 249-267 | UCUAGGUCUCCUCGCCAGGTT | 69 | CCUGGCGAGGAGACCUAGATT | 70 | AD-15280 |
| 250-268 | CUAGGUCUCCUCGCCAGGATT | 71 | UCCUGGCGAGGAGACCUAGTT | 72 | AD-15267 |
| 252-270 | AGGUCUCCUCGCCAGGACATT | 73 | UGUCCUGGCGAGGAGACCUTT | 74 | AD-15314 |
| 258-276 | CCUCGCCAGGACAGCAACCTT | 75 | GGUUGCUGUCCUGGCGAGGTT | 76 | AD-15315 |
| 300-318 | CGUCAGCUCCAGGCGGUCCTsT | 77 | GGACCGCCUGGAGCUGACGTsT | 78 | AD-9624 |
| 300-318 | cGucAGcuccAGGcGGuccTsT | 79 | GGACCGCCUGGAGCUGACGTsT | 80 | AD-9750 |
| 301-319 | GUCAGCUCCAGGCGGUCCUTsT | 81 | AGGACCGCCUGGAGCUGACTsT | 82 | AD-9623 |
| 301-319 | GucAGcuccAGGcGGuccuTsT | 83 | AGGACCGCCUGGAGCUGACTsT | 84 | AD-9749 |
| 370-388 | GGCGCCCGUGCGCAGGAGGTT | 85 | CCUCCUGCGCACGGGCGCCTT | 86 | AD-15384 |
| 408-426 | GGAGCUGGUGCUAGCCUUGTsT | 87 | CAAGGCUAGCACCAGCUCCTsT | 88 | AD-9607 |
| 408-426 | GGAGcuGGuGcuAGccuuGTsT | 89 | cAAGGCuAGcACcAGCUCCTsT | 90 | AD-9733 |
| 411-429 | GCUGGUGCUAGCCUUGCGUTsT | 91 | ACGCAAGGCUAGCACCAGCTsT | 92 | AD-9524 |
| 411-429 | GcuGGuGcuAGccuuGcGuTsT | 93 | ACGcAAGGCuAGcACcAGCTsT | 94 | AD-9650 |
| 412-430 | CUGGUGCUAGCCUUGCGUUTsT | 95 | AACGCAAGGCUAGCACCAGTsT | 96 | AD-9520 |
| 412-430 | CUGGUGCUAGCCUUGCGUUTsT | 97 | AACGCAAGGCUAGCACCAGTsT | 98 | AD-9520 |
| 412-430 | cuGGuGcuAGccuuGcGuuTsT | 99 | AACGcAAGGCuAGcACcAGTsT | 100 | AD-9646 |
| 416-434 | UGCUAGCCUUGCGUUCCGATsT | 101 | UCGGAACGCAAGGCUAGCATsT | 102 | AD-9608 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 416-434 | uGcuAGccuuGcGuuccGATsT | 103 | UCGGAACGcAAGGCuAGcATsT | 104 | AD-9734 |
| 419-437 | UAGCCUUGCGUUCCGAGGATsT | 105 | UCCUCGGAACGCAAGGCUATsT | 106 | AD-9546 |
| 419-437 | uAGccuuGcGuuccGAGGATsT | 107 | UCCUCGGAACGcAAGGCuATsT | 108 | AD-9672 |
| 439-457 | GACGGCCUGGCCGAAGCACTT | 109 | GUGCUUCGGCCAGGCCGUCTT | 110 | AD-15385 |
| 447-465 | GGCCGAAGCACCCGAGCACTT | 111 | GUGCUCGGGUGCUUCGGCCTT | 112 | AD-15393 |
| 448-466 | GCCGAAGCACCCGAGCACGTT | 113 | CGUGCUCGGGUGCUUCGGCTT | 114 | AD-15316 |
| 449-467 | CCGAAGCACCCGAGCACGGTT | 115 | CCGUGCUCGGGUGCUUCGGTT | 116 | AD-15317 |
| 458-476 | CCGAGCACGGAACCACAGCTT | 117 | GCUGUGGUUCCGUGCUCGGTT | 118 | AD-15318 |
| 484-502 | CACCGCUGCGCCAAGGAUCTT | 119 | GAUCCUUGGCGCAGCGGUGTT | 120 | AD-15195 |
| 486-504 | CCGCUGCGCCAAGGAUCCGTT | 121 | CGGAUCCUUGGCGCAGCGGTT | 122 | AD-15224 |
| 487-505 | CGCUGCGCCAAGGAUCCGUTT | 123 | ACGGAUCCUUGGCGCAGCGTT | 124 | AD-15188 |
| 489-507 | CUGCGCCAAGGAUCCGUGGTT | 125 | CCACGGAUCCUUGGCGCAGTT | 126 | AD-15225 |
| 500-518 | AUCCGUGGAGGUUGCCUGGTT | 127 | CCAGGCAACCUCCACGGAUTT | 128 | AD-15281 |
| 509-527 | GGUUGCCUGGCACCUACGUTT | 129 | ACGUAGGUGCCAGGCAACCTT | 130 | AD-15282 |
| 542-560 | AGGAGACCCACCUCUCGCATT | 131 | UGCGAGAGGUGGGUCUCCUTT | 132 | AD-15319 |
| 543-561 | GGAGACCCACCUCUCGCAGTT | 133 | CUGCGAGAGGUGGGUCUCCTT | 134 | AD-15226 |
| 544-562 | GAGACCCACCUCUCGCAGUTT | 135 | ACUGCGAGAGGUGGGUCUCTT | 136 | AD-15271 |
| 549-567 | CCACCUCUCGCAGUCAGAGTT | 137 | CUCUGACUGCGAGAGGUGGTT | 138 | AD-15283 |
| 552-570 | CCUCUCGCAGUCAGAGCGCTT | 139 | GCGCUCUGACUGCGAGAGGTT | 140 | AD-15284 |
| 553-571 | CUCUCGCAGUCAGAGCGCATT | 141 | UGCGCUCUGACUGCGAGAGTT | 142 | AD-15189 |
| 554-572 | UCUCGCAGUCAGAGCGCACTT | 143 | GUGCGCUCUGACUGCGAGATT | 144 | AD-15227 |
| 555-573 | CUCGCAGUCAGAGCGCACUTsT | 145 | AGUGCGCUCUGACUGCGAGTsT | 146 | AD-9547 |
| 555-573 | cucGcAGucAGAGcGcAcuTsT | 147 | AGUGCGCUCUGACUGCGAGTsT | 148 | AD-9673 |
| 558-576 | GCAGUCAGAGCGCACUGCCTsT | 149 | GGCAGUGCGCUCUGACUGCTsT | 150 | AD-9548 |
| 558-576 | GcAGucAGAGcGcAcuGccTsT | 151 | GGcAGUGCGCUCUGACUGCTsT | 152 | AD- |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| | | | | | 9674 |
| 606-624 | GGGAUACCUCACCAAGAUCTsT | 153 | GAUCUUGGUGAGGUAUCCCTsT | 154 | AD-9529 |
| 606-624 | GGGAuAccucAccAAGAucTsT | 155 | GAUCUUGGUGAGGuAUCCCTsT | 156 | AD-9655 |
| 659-677 | UGGUGAAGAUGAGUGGCGATsT | 157 | UCGCCACUCAUCUUCACCATsT | 158 | AD-9605 |
| 659-677 | uGGuGAAGAuGAGuGGCGATsT | 159 | UCGCcACUcAUCUUcACcATsT | 160 | AD-9731 |
| 663-681 | GAAGAUGAGUGGCGACCUGTsT | 161 | CAGGUCGCCACUCAUCUUCTsT | 162 | AD-9596 |
| 663-681 | GAAGAuGAGuGGcGAccuGTsT | 163 | cAGGUCGCcACUcAUCUUCTsT | 164 | AD-9722 |
| 704-722 | CCCAUGUCGACUACAUCGATsT | 165 | UCGAUGUAGUCGACAUGGGTsT | 166 | AD-9583 |
| 704-722 | cccAuGucGAcuAcAucGATsT | 167 | UCGAUGuAGUCGAcAUGGGTsT | 168 | AD-9709 |
| 718-736 | AUCGAGGAGGACUCCUCUGTsT | 169 | CAGAGGAGUCCUCCUCGAUTsT | 170 | AD-9579 |
| 718-736 | AucGAGGAGGAcuccucuGTsT | 171 | cAGAGGAGUCCUCCUCGAUTsT | 172 | AD-9705 |
| 758-776 | GGAACCUGGAGCGGAUUACTT | 173 | GUAAUCCGCUCCAGGUUCCTT | 174 | AD-15394 |
| 759-777 | GAACCUGGAGCGGAUUACCTT | 175 | GGUAAUCCGCUCCAGGUUCTT | 176 | AD-15196 |
| 760-778 | AACCUGGAGCGGAUUACCCTT | 177 | GGGUAAUCCGCUCCAGGUUTT | 178 | AD-15197 |
| 777-795 | CCCUCCACGGUACCGGGCGTT | 179 | CGCCCGGUACCGUGGAGGGTT | 180 | AD-15198 |
| 782-800 | CACGGUACCGGGCGGAUGATsT | 181 | UCAUCCGCCCGGUACCGUGTsT | 182 | AD-9609 |
| 782-800 | cAcGGuAccGGGcGGAuGATsT | 183 | UcAUCCGCCCGGuACCGUGTsT | 184 | AD-9735 |
| 783-801 | ACGGUACCGGGCGGAUGAATsT | 185 | UUCAUCCGCCCGGUACCGUTsT | 186 | AD-9537 |
| 783-801 | AcGGuAccGGGcGGAuGAATsT | 187 | UUcAUCCGCCCGGuACCGUTsT | 188 | AD-9663 |
| 784-802 | CGGUACCGGGCGGAUGAAUTsT | 189 | AUUCAUCCGCCCGGUACCGTsT | 190 | AD-9528 |
| 784-802 | cGGuAccGGGcGGAuGAAuTsT | 191 | AUUcAUCCGCCCGGuACCGTsT | 192 | AD-9654 |
| 785-803 | GGUACCGGGCGGAUGAAUATsT | 193 | UAUUCAUCCGCCCGGUACCTsT | 194 | AD-9515 |
| 785-803 | GGuAccGGGcGGAuGAAuATsT | 195 | uAUUcAUCCGCCCGGuACCTsT | 196 | AD-9641 |
| 786-804 | GUACCGGGCGGAUGAAUACTsT | 197 | GUAUUCAUCCGCCCGGUACTsT | 198 | AD-9514 |
| 786-804 | GuAccGGGcGGAuGAAuAcTsT | 199 | GuAUUcAUCCGCCCGGuACTsT | 200 | AD-9640 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 788-806 | ACCGGGCGGAUGAAUACCATsT | 201 | UGGUAUUCAUCCGCCCGGTsT | 202 | AD-9530 |
| 788-806 | AccGGGcGGAuGAAuAccATsT | 203 | UGGuAUUcAUCCGCCCGGTsT | 204 | AD-9656 |
| 789-807 | CCGGGCGGAUGAAUACCAGTsT | 205 | CUGGUAUUCAUCCGCCCGGTsT | 206 | AD-9538 |
| 789-807 | ccGGGcGGAuGAAuAccAGTsT | 207 | CUGGuAUUcAUCCGCCCGGTsT | 208 | AD-9664 |
| 825-843 | CCUGGUGGAGGUGUAUCUCTsT | 209 | GAGAUACACCUCCACCAGGTsT | 210 | AD-9598 |
| 825-843 | ccuGGuGGAGGuGuAucucTsT | 211 | GAGAuAcACCUCcACcAGGTsT | 212 | AD-9724 |
| 826-844 | CUGGUGGAGGUGUAUCUCCTsT | 213 | GGAGAUACACCUCCACCAGTsT | 214 | AD-9625 |
| 826-844 | cuGGuGGAGGuGuAucuccTsT | 215 | GGAGAuAcACCUCcACcAGTsT | 216 | AD-9751 |
| 827-845 | UGGUGGAGGUGUAUCUCCUTsT | 217 | AGGAGAUACACCUCCACCATsT | 218 | AD-9556 |
| 827-845 | uGGuGGAGGuGuAucuccuTsT | 219 | AGGAGAuAcACCUCcACcATsT | 220 | AD-9682 |
| 828-846 | GGUGGAGGUGUAUCUCCUATsT | 221 | UAGGAGAUACACCUCCACCTsT | 222 | AD-9539 |
| 828-846 | GGuGGAGGuGuAucuccuATsT | 223 | uAGGAGAuAcACCUCcACCTsT | 224 | AD-9665 |
| 831-849 | GGAGGUGUAUCUCCUAGACTsT | 225 | GUCUAGGAGAUACACCUCCTsT | 226 | AD-9517 |
| 831-849 | GGAGGuGuAucuccuAGAcTsT | 227 | GUCuAGGAGAuAcACCUCCTsT | 228 | AD-9643 |
| 833-851 | AGGUGUAUCUCCUAGACACTsT | 229 | GUGUCUAGGAGAUACACCUTsT | 230 | AD-9610 |
| 833-851 | AGGuGuAucuccuAGAcAcTsT | 231 | GUGUCuAGGAGAuAcACCUTsT | 232 | AD-9736 |
| 833-851 | AfgGfuGfuAfuCfuCfcUfaGfaCfaCfTsT | 233 | p-gUfgUfcUfaGfgAfgAfuAfcAfcCfuTsT | 234 | AD-14681 |
| 833-851 | AGGUfGUfAUfCfUfCfCfUfAGACfACfTsT | 235 | GUfGUfCfUfAGGAGAUfACfACfCfUfTsT | 236 | AD-14691 |
| 833-851 | AgGuGuAuCuCcUaGaCaCTsT | 237 | p-gUfgUfcUfaGfgAfgAfuAfcAfcCfuTsT | 238 | AD-14701 |
| 833-851 | AgGuGuAuCuCcUaGaCaCTsT | 239 | GUfGUfCfUfAGGAGAUfACfACfCfUfTsT | 240 | AD-14711 |
| 833-851 | AfgGfuGfuAfuCfuCfcUfaGfaCfaCfTsT | 241 | GUGUCuaGGagAUACAccuTsT | 242 | AD-14721 |
| 833-851 | AGGUfGUfAUfCfUfCfCfUfAGACfACfTsT | 243 | GUGUCuaGGagAUACAccuTsT | 244 | AD-14731 |
| 833-851 | AgGuGuAuCuCcUaGaCaCTsT | 245 | GUGUCuaGGagAUACAccuTsT | 246 | AD-14741 |
| 833-851 | GfcAfcCfcUfcAfuAfgGfcCfuGfgATsT | 247 | p-uCfcAfgGfcCfuAfuGfaGfgGfuGfcTsT | 248 | AD-15087 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 833-851 | GCfACfCfCfUfCfAUfAGGCfCfUfGGATsT | 249 | UfCfCfAGGCfCfUfAUfGAGGGUfGCfTsT | 250 | AD-15097 |
| 833-851 | GcAcCcUcAuAgGcCuGgATsT | 251 | p-uCfcAfgGfcCfuAfuGfaGfgGfuGfcTsT | 252 | AD-15107 |
| 833-851 | GcAcCcUcAuAgGcCuGgATsT | 253 | UfCfCfAGGCfCfUfAUfGAGGGUfGCfTsT | 254 | AD-15117 |
| 833-851 | GfcAfcCfcUfcAfuAfgGfcCfuGfgAfTsT | 255 | UCCAGgcCUauGAGGGugcTsT | 256 | AD-15127 |
| 833-851 | GCfACfCfCfUfCfAUfAGGCfCfUfGGATsT | 257 | UCCAGgcCUauGAGGGugcTsT | 258 | AD-15137 |
| 833-851 | GcAcCcUcAuAgGcCuGgATsT | 259 | UCCAGgcCUauGAGGGugcTsT | 260 | AD-15147 |
| 836-854 | UGUAUCUCCUAGACACCAGTsT | 261 | CUGGUGUCUAGGAGAUACATsT | 262 | AD-9516 |
| 836-854 | uGuAucuccuAGAcAccAGTsT | 263 | CUGGUGUCUAGGAGAUAcATsT | 264 | AD-9642 |
| 840-858 | UCUCCUAGACACCAGCAUATsT | 265 | UAUGCUGGUGUCUAGGAGATsT | 266 | AD-9562 |
| 840-858 | ucuccuAGAcAccAGcAuATsT | 267 | uAUGCUGGUGUCUAGGAGATsT | 268 | AD-9688 |
| 840-858 | UfcUfcCfuAfgAfcAfcCfaGfcAfuAfTsT | 269 | p-uAfuGfcUfgGfuGfuCfuAfgGfaGfaTsT | 270 | AD-14677 |
| 840-858 | UfCfUfCfCfUfAGACfACfCfAGCfAUfATsT | 271 | UfAUfGCfUfGGUfGUfCfUfAGGAGATsT | 272 | AD-14687 |
| 840-858 | UcUcCuAgAcAcCaGcAuATsT | 273 | p-uAfuGfcUfgGfuGfuCfuAfgGfaGfaTsT | 274 | AD-14697 |
| 840-858 | UcUcCuAgAcAcCaGcAuATsT | 275 | UfAUfGCfUfGGUfGUfCfUfAGGAGATsT | 276 | AD-14707 |
| 840-858 | UfcUfcCfuAafcAfcCfaGfcAfuAfTsT | 277 | UAUGCugGUguCUAGGagaTsT | 278 | AD-14717 |
| 840-858 | UfCfUfCfCfUfAGACfACfCfAGCfAUfATsT | 279 | UAUGCugGUguCUAGGagaTsT | 280 | AD-14727 |
| 840-858 | UcUcCuAgAcAcCaGcAuATsT | 281 | UAUGCugGUguCUAGGagaTsT | 282 | AD-14737 |
| 840-858 | AfgGfcCfuGfgAfgUfuUfaUfuCfgGfTsT | 283 | p-cCfgAfaUfaAfaCfuCfcAfgGfcCfuTsT | 284 | AD-15083 |
| 840-858 | AGGCfCfUfGGAGUfUfUfAUfUfCfGGTsT | 285 | CfCfGAAUfAAACfUfCfCfAGGCfCfUfTsT | 286 | AD-15093 |
| 840-858 | AgGcCuGgAgUuUaUuCgGTsT | 287 | p-cCfgAfaUfaAfaCfuCfcAfgGfcCfuTsT | 288 | AD-15103 |
| 840-858 | AgGcCuGgAgUuUaUuCgGTsT | 289 | CfCfGAAUfAAACfUfCfCfAGGCfCfUfTsT | 290 | AD-15113 |
| 840-858 | AfgGfcCfuGfgAfgUfuUfaUfuCfgGfTsT | 291 | CCGAAuaAAcuCCAGGccuTsT | 292 | AD-15123 |
| 840-858 | AGGCfCfUfGGAGUfUfUfAUfUfCfGGTsT | 293 | CCGAAuaAAcuCCAGGccuTsT | 294 | AD-15133 |
| 840-858 | AgGcCuGgAgUuUaUuCgGTsT | 295 | CCGAAuaAAcuCCAGGccuTsT | 296 | AD-15143 |
| 841-859 | CUCCUAGACACCAGCAUACTsT | 297 | GUAUGCUGGUGUCUAGGAGTsT | 298 | AD- |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| | | | | | 9521 |
| 841-859 | cuccuAGAcAccAGcAuAcTsT | 299 | GuAUGCUGGUGUCuAGGAGTsT | 300 | AD-9647 |
| 842-860 | UCCUAGACACCAGCAUACATsT | 301 | UGUAUGCUGGUGUCUAGGATsT | 302 | AD-9611 |
| 842-860 | uccuAGAcAccAGcAuAcATsT | 303 | UGuAUGCUGGUGUCuAGGATsT | 304 | AD-9737 |
| 843-861 | CCUAGACACCAGCAUACAGTsT | 305 | CUGUAUGCUGGUGUCUAGGTsT | 306 | AD-9592 |
| 843-861 | ccuAGAcAccAGcAuAcAGTsT | 307 | CUGuAUGCUGGUGUCuAGGTsT | 308 | AD-9718 |
| 847-865 | GACACCAGCAUACAGAGUGTsT | 309 | CACUCUGUAUGCUGGUGUCTsT | 310 | AD-9561 |
| 847-865 | GAcAccAGcAuAcAGAGuGTsT | 311 | cACUCUGuAUGCUGGUGUCTsT | 312 | AD-9687 |
| 855-873 | CAUACAGAGUGACCACCGGTsT | 313 | CCGGUGGUCACUCUGUAUGTsT | 314 | AD-9636 |
| 855-873 | cAuAcAGAGuGAccAccGGTsT | 315 | CCGGUGGUcACUCUGuAUGTsT | 316 | AD-9762 |
| 860-878 | AGAGUGACCACCGGGAAAUTsT | 317 | AUUUCCCGGUGGUCACUCUTsT | 318 | AD-9540 |
| 860-878 | AGAGuGAccAccGGGAAAuTsT | 319 | AUUUCCCGGUGGUcACUCUTsT | 320 | AD-9666 |
| 861-879 | GAGUGACCACCGGGAAAUCTsT | 321 | GAUUUCCCGGUGGUCACUCTsT | 322 | AD-9535 |
| 861-879 | GAGuGAccAccGGGAAAucTsT | 323 | GAUUUCCCGGUGGUcACUCTsT | 324 | AD-9661 |
| 863-881 | GUGACCACCGGGAAAUCGATsT | 325 | UCGAUUUCCCGGUGGUCACTsT | 326 | AD-9559 |
| 863-881 | GuGAccAccGGGAAAucGATsT | 327 | UCGAUUUCCCGGUGGUcACTsT | 328 | AD-9685 |
| 865-883 | GACCACCGGGAAAUCGAGGTsT | 329 | CCUCGAUUUCCCGGUGGUCTsT | 330 | AD-9533 |
| 865-883 | GAccAccGGGAAAucGAGGTsT | 331 | CCUCGAUUUCCCGGUGGUCTsT | 332 | AD-9659 |
| 866-884 | ACCACCGGGAAAUCGAGGGTsT | 333 | CCCUCGAUUUCCCGGUGGUTsT | 334 | AD-9612 |
| 866-884 | AccAccGGGAAAucGAGGGTsT | 335 | CCCUCGAUUUCCCGGUGGUTsT | 336 | AD-9738 |
| 867-885 | CCACCGGGAAAUCGAGGGCTsT | 337 | GCCCUCGAUUUCCCGGUGGTsT | 338 | AD-9557 |
| 867-885 | ccAccGGGAAAucGAGGGcTsT | 339 | GCCCUCGAUUUCCCGGUGGTsT | 340 | AD-9683 |
| 875-893 | AAAUCGAGGGCAGGGUCAUTsT | 341 | AUGACCCUGCCCUCGAUUUTsT | 342 | AD-9531 |
| 875-893 | AAAucGAGGGcAGGGucAuTsT | 343 | AUGACCCUGCCCUCGAUUUTsT | 344 | AD-9657 |
| 875-893 | AfaAfuCfgAfgGfgCfaGfgGfuCfaUfTsT | 345 | p-aUfgAfcCfcUfgCfcCfuCfgAfuUfuTsT | 346 | AD-14673 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 875-893 | AAAUfCfGAGGGCfAGGGUfCfAUfTsT | 347 | AUfGACfCfCfUfGCfCfCfUfCfGAUfUfUfTsT | 348 | AD-14683 |
| 875-893 | AaAuCgAgGgCaGgGuCaUTsT | 349 | p-aUfgAfcCfcUfgCfcCfuCfgAfuUfuTsT | 350 | AD-14693 |
| 875-893 | AaAuCgAgGgCaGgGuCaUTsT | 351 | AUfGACfCfCfUfGCfCfCfUfCfGAUfUfUfTsT | 352 | AD-14703 |
| 875-893 | AfaAfuCfgAfgGfgCfaGfgGfuCfaUfTsT | 353 | AUGACccUGccCUCGAuuuTsT | 354 | AD-14713 |
| 875-893 | AAAUfCfGAGGGCfAGGGUfCfAUfTsT | 355 | AUGACccUGccCUCGAuuuTsT | 356 | AD-14723 |
| 875-893 | AaAuCgAgGgCaGgGuCaUTsT | 357 | AUGACccUGccCUCGAuuuTsT | 358 | AD-14733 |
| 875-893 | CfgGfcAfcCfcUfcAfuAfgGfcCfuGfTsT | 359 | p-cAfgGfcCfuAfuGfaGfgGfuGfcCfgTsT | 360 | AD-15079 |
| 875-893 | CfGGCfACfCfCfUfCfAUfAGGCfCfUfGTsT | 361 | CfAGGCfCfUfAUfGAGGGUfGCfCfGTsT | 362 | AD-15089 |
| 875-893 | CgGcAcCcUcAuAgGcCuGTsT | 363 | p-cAfgGfcCfuAfuGfaGfgGfuGfcCfgTsT | 364 | AD-15099 |
| 875-893 | CgGcAcCcUcAuAgGcCuGTsT | 365 | CfAGGCfCfUfAUfGAGGGUfGCfCfGTsT | 366 | AD-15109 |
| 875-893 | CfgGfcAfcCfcUfcAfuAfgGfcCfuGfTsT | 367 | CAGGCcuAUgaGGGUGccgTsT | 368 | AD-15119 |
| 875-893 | CfGGCfACfCfCfUfCfAUfAGGCfCfUfGTsT | 369 | CAGGCcuAUgaGGGUGccgTsT | 370 | AD-15129 |
| 875-893 | CgGcAcCcUcAuAgGcCuGTsT | 371 | CAGGCcuAUgaGGGUGccgTsT | 372 | AD-15139 |
| 877-895 | AUCGAGGGCAGGGUCAUGGsT | 373 | CCAUGACCCUGCCCUCGAUTsT | 374 | AD-9542 |
| 877-895 | AucGAGGGcAGGGucAuGGTsT | 375 | CcAUGACCCUGCCCUCGAUTsT | 376 | AD-9668 |
| 878-896 | cGAGGGcAGGGucAuGGucTsT | 377 | GACcAUGACCCUGCCCUCGTsT | 378 | AD-9739 |
| 880-898 | GAGGGCAGGGUCAUGGUCATsT | 379 | UGACCAUGACCCUGCCCUCTsT | 380 | AD-9637 |
| 880-898 | GAGGGcAGGGucAuGGucATsT | 381 | UGAccAUGACCCUGCCCUCTsT | 382 | AD-9763 |
| 882-900 | GGGCAGGGUCAUGGUCACCTsT | 383 | GGUGACCAUGACCCUGCCCTsT | 384 | AD-9630 |
| 882-900 | GGGcAGGGucAuGGucAccTsT | 385 | GGUGAccAUGACCCUGCCCTsT | 386 | AD-9756 |
| 885-903 | CAGGGUCAUGGUCACCGACTsT | 387 | GUCGGUGACCAUGACCCUGTsT | 388 | AD-9593 |
| 885-903 | cAGGGucAuGGucAccGAcTsT | 389 | GUCGGUGACcAUGACCCUGTsT | 390 | AD-9719 |
| 886-904 | AGGGUCAUGGUCACCGACUTsT | 391 | AGUCGGUGACCAUGACCCUTsT | 392 | AD-9601 |
| 886-904 | AGGGucAuGGucAccGAcuTsT | 393 | AGUCGGUGACcAUGACCCUTsT | 394 | AD-9727 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 892-910 | AUGGUCACCGACUUCGAGATsT | 395 | UCUCGAAGUCGGUGACCAUTsT | 396 | AD-9573 |
| 892-910 | AuGGucAccGAcuucGAGATsT | 397 | UCUCGAAGUCGGUGAcCAUTsT | 398 | AD-9699 |
| 899-917 | CCGACUUCGAGAAUGUGCCTT | 399 | GGCACAUUCUCGAAGUCGGTT | 400 | AD-15228 |
| 921-939 | GGAGGACGGGACCCGCUUCTT | 401 | GAAGCGGGUCCCGUCCUCCTT | 402 | AD-15395 |
| 993-1011 | CAGCGGCCGGGAUGCCGGCTsT | 403 | GCCGGCAUCCCGGCCGCUGTsT | 404 | AD-9602 |
| 993-1011 | cAGcGGccGGGAuGccGGcTsT | 405 | GCCGGcAUCCCGGCCGCUGTsT | 406 | AD-9728 |
| 1020-1038 | GGGUGCCAGCAUGCGCAGCTT | 407 | GCUGCGCAUGCUGGCACCCTT | 408 | AD-15386 |
| 1038-1056 | CCUGCGCGUGCUCAACUGCTsT | 409 | GCAGUUGAGCACGCGCAGGTsT | 410 | AD-9580 |
| 1038-1056 | ccuGcGcGuGcucAAcuGcTsT | 411 | GcAGUUGAGcACGCGcAGGTsT | 412 | AD-9706 |
| 1040-1058 | UGCGCGUGCUCAACUGCCATsT | 413 | UGGCAGUUGAGCACGCGCATsT | 414 | AD-9581 |
| 1040-1058 | uGcGcGuGcucAAcuGccATsT | 415 | UGGcAGUUGAGcACGCGcATsT | 416 | AD-9707 |
| 1042-1060 | CGCGUGCUCAACUGCCAAGTsT | 417 | CUUGGCAGUUGAGCACGCGTsT | 418 | AD-9543 |
| 1042-1060 | cGcGuGcucAAcuGccAAGTsT | 419 | CUUGGcAGUUGAGcACGCGTsT | 420 | AD-9669 |
| 1053-1071 | CUGCCAAGGGAAGGGCACGTsT | 421 | CGUGCCCUUCCCUUGGCAGTsT | 422 | AD-9574 |
| 1053-1071 | cuGccAAGGGAAGGGcAcGTsT | 423 | CGUGCCCUUCCCUUGGcAGTsT | 424 | AD-9700 |
| 1057-1075 | CAAGGGAAGGGCACGGUUATT | 425 | UAACCGUGCCCUUCCCUUGTT | 426 | AD-15320 |
| 1058-1076 | AAGGGAAGGGCACGGUUAGTT | 427 | CUAACCGUGCCCUUCCCUUTT | 428 | AD-15321 |
| 1059-1077 | AGGGAAGGGCACGGUUAGCTT | 429 | GCUAACCGUGCCCUUCCCUTT | 430 | AD-15199 |
| 1060-1078 | GGGAAGGGCACGGUUAGCGTT | 431 | CGCUAACCGUGCCCUUCCCTT | 432 | AD-15167 |
| 1061-1079 | GGAAGGGCACGGUUAGCGGTT | 433 | CCGCUAACCGUGCCCUUCCTT | 434 | AD-15164 |
| 1062-1080 | GAAGGGCACGGUUAGCGGCTT | 435 | GCCGCUAACCGUGCCCUUCTT | 436 | AD-15166 |
| 1063-1081 | AAGGGCACGGUUAGCGGCATT | 437 | UGCCGCUAACCGUGCCCUUTT | 438 | AD-15322 |
| 1064-1082 | AGGGCACGGUUAGCGGCACTT | 439 | GUGCCGCUAACCGUGCCCUTT | 440 | AD-15200 |
| 1068-1086 | CACGGUUAGCGGCACCCUCTT | 441 | GAGGGUGCCGCUAACCGUGTT | 442 | AD-15213 |
| 1069-1087 | ACGGUUAGCGGCACCCUCATT | 443 | UGAGGGUGCCGCUAACCGUTT | 444 | AD- |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| | | | | | 15229 |
| 1072-1090 | GUUAGCGGCACCCUCAUAGTT | 445 | CUAUGAGGGUGCCGCUAACTT | 446 | AD-15215 |
| 1073-1091 | UUAGCGGCACCCUCAUAGGTT | 447 | CCUAUGAGGGUGCCGCUAATT | 448 | AD-15214 |
| 1076-1094 | GCGGCACCCUCAUAGGCCUsT | 449 | AGGCCUAUGAGGGUGCCGCTsT | 450 | AD-9315 |
| 1079-1097 | GCACCCUCAUAGGCCUGGAsT | 451 | UCCAGGCCUAUGAGGGUGCTsT | 452 | AD-9326 |
| 1085-1103 | UCAUAGGCCUGGAGUUUAUTsT | 453 | AUAAACUCCAGGCCUAUGATsT | 454 | AD-9318 |
| 1090-1108 | GGCCUGGAGUUUAUUCGGAsT | 455 | UCCGAAUAAACUCCAGGCCTsT | 456 | AD-9323 |
| 1091-1109 | GCCUGGAGUUUAUUCGGAATsT | 457 | UUCCGAAUAAACUCCAGGCTsT | 458 | AD-9314 |
| 1091-1109 | GccuGGAGuuuAuucGGAATsT | 459 | UUCCGAAuAAACUCcAGGCTsT | 460 | AD-10792 |
| 1091-1109 | GccuGGAGuuuAuucGGAATsT | 461 | UUCCGAAUAACUCCAGGCTsT | 462 | AD-10796 |
| 1093-1111 | CUGGAGUUUAUUCGGAAAATsT | 463 | UUUUCCGAAUAAACUCCAGTsT | 464 | AD-9638 |
| 1093-1111 | cuGGAGuuuAuucGGAAAATsT | 465 | UUUUCCGAAuAAACUCcAGTsT | 466 | AD-9764 |
| 1095-1113 | GGAGUUUAUUCGGAAAAGCTsT | 467 | GCUUUUCCGAAUAAACUCCTsT | 468 | AD-9525 |
| 1095-1113 | GGAGuuuAuucGGAAAAGcTsT | 469 | GCUUUUCCGAAuAAACUCCTsT | 470 | AD-9651 |
| 1096-1114 | GAGUUUAUUCGGAAAAGCCTsT | 471 | GGCUUUUCCGAAUAAACUCTsT | 472 | AD-9560 |
| 1096-1114 | GAGuuuAuucGGAAAAGccTsT | 473 | GGCUUUUCCGAAuAAACUCTsT | 474 | AD-9686 |
| 1100-1118 | UUAUUCGGAAAAGCCAGCUTsT | 475 | AGCUGGCUUUUCCGAAUAATsT | 476 | AD-9536 |
| 1100-1118 | uuAuucGGAAAAGccAGcuTsT | 477 | AGCUGGCUUUUCCGAAuAATsT | 478 | AD-9662 |
| 1154-1172 | CCCUGGCGGGUGGGUACAGTsT | 479 | CUGUACCCACCCGCCAGGGTsT | 480 | AD-9584 |
| 1154-1172 | cccuGGcGGGuGGGuAcAGTsT | 481 | CUGuACCcACCCGCcAGGGTsT | 482 | AD-9710 |
| 1155-1173 | CCUGGCGGGUGGGUACAGCTT | 483 | GCUGUACCCACCCGCCAGGTT | 484 | AD-15323 |
| 1157-1175 | UGGCGGGUGGGUACAGCCGTsT | 485 | CGGCUGUACCCACCCGCCATsT | 486 | AD-9551 |
| 1157-1175 | uGGcGGGuGGGuAcAGccGTsT | 487 | CGGCUGuACCcACCCGCcATsT | 488 | AD-9677 |
| 1158-1176 | GGCGGGUGGGUACAGCCGCTT | 489 | GCGGCUGUACCCACCCGCCTT | 490 | AD-15230 |
| 1162-1180 | GGUGGGUACAGCCGCGUCCTT | 491 | GGACGCGGCUGUACCCACCTT | 492 | AD-15231 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 1164-1182 | UGGGUACAGCCGCGUCCUCTT | 493 | GAGGACGCGGCUGUACCCATT | 494 | AD-15285 |
| 1172-1190 | GCCGCGUCCUCAACGCCGCTT | 495 | GCGGCGUUGAGGACGCGGCTT | 496 | AD-15396 |
| 1173-1191 | CCGCGUCCUCAACGCCGCCTT | 497 | GGCGGCGUUGAGGACGCGGTT | 498 | AD-15397 |
| 1216-1234 | GUCGUGCUGGUCACCGCUGTsT | 499 | CAGCGGUGACCAGCACGACTsT | 500 | AD-9600 |
| 1216-1234 | GucGuGcuGGucAccGcuGTsT | 501 | cAGCGGUGACcAGcACGACTsT | 502 | AD-9726 |
| 1217-1235 | UCGUGCUGGUCACCGCUGCTsT | 503 | GCAGCGGUGACCAGCACGATsT | 504 | AD-9606 |
| 1217-1235 | ucGuGcuGGucAccGcuGcTsT | 505 | GcAGCGGUGACcAGcACGATsT | 506 | AD-9732 |
| 1223-1241 | UGGUCACCGCUGCCGGCAATsT | 507 | UUGCCGGCAGCGGUGACCATsT | 508 | AD-9633 |
| 1223-1241 | uGGucAccGcuGccGGcAATsT | 509 | UUGCCGGcAGCGGUGACcATsT | 510 | AD-9759 |
| 1224-1242 | GGUCACCGCUGCCGGCAACTsT | 511 | GUUGCCGGCAGCGGUGACCTsT | 512 | AD-9588 |
| 1224-1242 | GGucAccGcuGccGGcAAcTsT | 513 | GUUGCCGGcAGCGGUGACCTsT | 514 | AD-9714 |
| 1227-1245 | CACCGCUGCCGGCAACUUCTsT | 515 | GAAGUUGCCGGCAGCGGUGTsT | 516 | AD-9589 |
| 1227-1245 | cAccGcuGccGGcAAcuucTsT | 517 | GAAGUUGCCGGcAGCGGUGTsT | 518 | AD-9715 |
| 1229-1247 | CCGCUGCCGGCAACUUCCGTsT | 519 | CGGAAGUUGCCGGCAGCGGTsT | 520 | AD-9575 |
| 1229-1247 | ccGcuGccGGcAAcuuccGTsT | 521 | CGGAAGUUGCCGGcAGCGGTsT | 522 | AD-9701 |
| 1230-1248 | CGCUGCCGGCAACUUCCGGTsT | 523 | CCGGAAGUUGCCGGCAGCGTsT | 524 | AD-9563 |
| 1230-1248 | cGcuGccGGcAAcuuccGGTsT | 525 | CCGGAAGUUGCCGGcAGCGTsT | 526 | AD-9689 |
| 1231-1249 | GCUGCCGGCAACUUCCGGGTsT | 527 | CCCGGAAGUUGCCGGCAGCTsT | 528 | AD-9594 |
| 1231-1249 | GcuGccGGcAAcuuccGGGTsT | 529 | CCCGGAAGUUGCCGGcAGCTsT | 530 | AD-9720 |
| 1236-1254 | CGGCAACUUCCGGGACGAUTsT | 531 | AUCGUCCCGGAAGUUGCCGTsT | 532 | AD-9585 |
| 1236-1254 | cGGcAAcuccGGGAcGAuTsT | 533 | AUCGUCCCGGAAGUUGCCGTsT | 534 | AD-9711 |
| 1237-1255 | GGCAACUUCCGGGACGAUGTsT | 535 | CAUCGUCCCGGAAGUUGCCTsT | 536 | AD-9614 |
| 1237-1255 | GGcAAcuuccGGGAcGAuGTsT | 537 | cAUCGUCCCGGAAGUUGCCTsT | 538 | AD-9740 |
| 1243-1261 | UUCCGGGACGAUGCCUGCCTsT | 539 | GGCAGGCAUCGUCCCGGAATsT | 540 | AD-9615 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 1243-1261 | uuccGGGAcGAuGCCugCcuGccTsT | 541 | GGcAGGcAUCGUCCCGGAATsT | 542 | AD-9741 |
| 1248-1266 | GGACGAUGCCUGCCUCUACTsT | 543 | GUAGAGGCAGGCAUCGUCCTsT | 544 | AD-9534 |
| 1248-1266 | GGACGAUGCCUGCCUCUACTsT | 545 | GUAGAGGCAGGCAUCGUCCTsT | 546 | AD-9534 |
| 1248-1266 | GGAcGAuGccuGccucuAcTsT | 547 | GuAGAGGcAGGcAUCGUCCTsT | 548 | AD-9660 |
| 1279-1297 | GCUCCCGAGGUCAUCACAGTT | 549 | CUGUGAUGACCUCGGGAGCTT | 550 | AD-15324 |
| 1280-1298 | CUCCCGAGGUCAUCACAGUTT | 551 | ACUGUGAUGACCUCGGGAGTT | 552 | AD-15232 |
| 1281-1299 | UCCCGAGGUCAUCACAGUUTT | 553 | AACUGUGAUGACCUCGGGATT | 554 | AD-15233 |
| 1314-1332 | CCAAGACCAGCCGGUGACCTT | 555 | GGUCACCGGCUGGUCUUGGTT | 556 | AD-15234 |
| 1315-1333 | CAAGACCAGCCGGUGACCCTT | 557 | GGGUCACCGGCUGGUCUUGTT | 558 | AD-15286 |
| 1348-1366 | ACCAACUUUGGCCGCUGUGTsT | 559 | CACAGCGGCCAAAGUUGGUTsT | 560 | AD-9590 |
| 1348-1366 | AccAAcuuuGGccGcuGuGTsT | 561 | cAcAGCGGCcAAAGUUGGUTsT | 562 | AD-9716 |
| 1350-1368 | CAACUUUGGCCGCUGUGUGTsT | 563 | CACACAGCGGCCAAAGUUGTsT | 564 | AD-9632 |
| 1350-1368 | cAAcuuuGGccGcuGuGuGTsT | 565 | cAcAcAGCGGCcAAAGUUGTsT | 566 | AD-9758 |
| 1360-1378 | CGCUGUGUGGACCUCUUUGTsT | 567 | CAAAGAGGUCCACACAGCGTsT | 568 | AD-9567 |
| 1360-1378 | cGcuGuGuGGAccucuuuGTsT | 569 | cAAAGAGGUCcAcAcAGCGTsT | 570 | AD-9693 |
| 1390-1408 | GACAUCAUUGGUGCCUCCATsT | 571 | UGGAGGCACCAAUGAUGUCTsT | 572 | AD-9586 |
| 1390-1408 | GAcAucAuuGGuGccuccATsT | 573 | UGGAGGcAccAAUGAUGUCTsT | 574 | AD-9712 |
| 1394-1412 | UCAUUGGUGCCUCCAGCGATsT | 575 | UCGCUGGAGGCACCAAUGATsT | 576 | AD-9564 |
| 1394-1412 | ucAuuGGuGccuccAGcGATsT | 577 | UCGCUGGAGGcAccAAUGATsT | 578 | AD-9690 |
| 1417-1435 | AGCACCUGCUUUGUGUCACTsT | 579 | GUGACACAAAGCAGGUGCUTsT | 580 | AD-9616 |
| 1417-1435 | AGcAccuGcuuuGuGucAcTsT | 581 | GUGAcAcAAAGcAGGUGCUTsT | 582 | AD-9742 |
| 1433-1451 | CACAGAGUGGGACAUCACATT | 583 | UGUGAUGUCCCACUCUGUTT | 584 | AD-15398 |
| 1486-1504 | AUGCUGUCUGCCGAGCCGGTsT | 585 | CCGGCUCGGCAGACAGCAUTsT | 586 | AD-9617 |
| 1486-1504 | AuGcuGucuGccGAGccGGTsT | 587 | CCGGCUCGGcAGAcAGcAUTsT | 588 | AD-9743 |
| 1491-1509 | GUCUGCCGAGCCGGAGCUCTsT | 589 | GAGCUCCGGCUCGGCAGACTsT | 590 | AD- |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| | | | | | 9635 |
| 1491-1509 | GucuGccGAGccGGAGcucTsT | 591 | GAGCUCCGGCUCGGcAGACTsT | 592 | AD-9761 |
| 1521-1539 | GUUGAGGCAGAGACUGAUCTsT | 593 | GAUCAGUCUCUGCCUCAACTsT | 594 | AD-9568 |
| 1521-1539 | GuuGAGGcAGAGAcuGAucTsT | 595 | GAUcAGUCUCUGCCUcAACTsT | 596 | AD-9694 |
| 1527-1545 | GCAGAGACUGAUCCACUUCTsT | 597 | GAAGUGGAUCAGUCUCUGCTsT | 598 | AD-9576 |
| 1527-1545 | GcAGAGAcuGAuccAcuucTsT | 599 | GAAGUGGAUcAGUCUCUGCTsT | 600 | AD-9702 |
| 1529-1547 | AGAGACUGAUCCACUUCUCTsT | 601 | GAGAAGUGGAUCAGUCUCUTsT | 602 | AD-9627 |
| 1529-1547 | AGAGAcuGAuccAcuucucTsT | 603 | GAGAAGUGGAUcAGUCUCUTsT | 604 | AD-9753 |
| 1543-1561 | UUCUCUGCCAAAGAUGUCATsT | 605 | UGACAUCUUUGGCAGAGAATsT | 606 | AD-9628 |
| 1543-1561 | uucucuGccAAAGAuGucATsT | 607 | UGAcAUCUUUGGcAGAGAATsT | 608 | AD-9754 |
| 1545-1563 | CUCUGCCAAAGAUGUCAUCTsT | 609 | GAUGACAUCUUUGGCAGAGTsT | 610 | AD-9631 |
| 1545-1563 | cucuGccAAAGAuGucAucTsT | 611 | GAUGAcAUCUUUGGcAGAGTsT | 612 | AD-9757 |
| 1580-1598 | CUGAGGACCAGCGGGUACUTsT | 613 | AGUACCCGCUGGUCCUCAGTsT | 614 | AD-9595 |
| 1580-1598 | cuGAGGAccAGcGGGuAcuTsT | 615 | AGuACCCGCUGGUCCUcAGTsT | 616 | AD-9721 |
| 1581-1599 | UGAGGACCAGCGGGUACUGTsT | 617 | CAGUACCCGCUGGUCCUCATsT | 618 | AD-9544 |
| 1581-1599 | uGAGGAccAGcGGGuAcuGTsT | 619 | cAGuACCCGCUGGUCCUcATsT | 620 | AD-9670 |
| 1666-1684 | ACUGUAUGGUCAGCACACUTT | 621 | AGUGUGCUGACCAUACAGUTT | 622 | AD-15235 |
| 1668-1686 | UGUAUGGUCAGCACACUCGTT | 623 | CGAGUGUGCUGACCAUACATT | 624 | AD-15236 |
| 1669-1687 | GUAUGGUCAGCACACUCGGTT | 625 | CCGAGUGUGCUGACCAUACTT | 626 | AD-15168 |
| 1697-1715 | GGAUGGCCACAGCCGUCGCTT | 627 | GCGACGGCUGUGGCCAUCCTT | 628 | AD-15174 |
| 1698-1716 | GAUGGCCACAGCCGUCGCCTT | 629 | GGCGACGGCUGUGGCCAUCTT | 630 | AD-15325 |
| 1806-1824 | CAAGCUGGUCUGCCGGGCCTT | 631 | GGCCCGGCAGACCAGCUUGTT | 632 | AD-15326 |
| 1815-1833 | CUGCCGGGCCCACAACGCUTsT | 633 | AGCGUUGUGGGCCCGGCAGTsT | 634 | AD-9570 |
| 1815-1833 | cuGccGGGcccAcAAcGcuTsT | 635 | AGCGUUGUGGGCCCGGcAGTsT | 636 | AD-9696 |
| 1816-1834 | UGCCGGGCCCACAACGCUUTsT | 637 | AAGCGUUGUGGGCCCGGCATsT | 638 | AD-9566 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 1816-1834 | uGccGGGcccAcAAcGcuuTsT | 639 | AAGCGUUGUGGGCCCGGcATsT | 640 | AD-9692 |
| 1818-1836 | CCGGGCCCACAACGCUUUUTsT | 641 | AAAAGCGUUGUGGGCCCGGTsT | 642 | AD-9532 |
| 1818-1836 | ccGGGcccAcAAcGcuuuuTsT | 643 | AAAAGCGUUGUGGGCCCGGTsT | 644 | AD-9658 |
| 1820-1838 | GGGCCCACAACGCUUUUGGTsT | 645 | CCAAAAGCGUUGUGGGCCCTsT | 646 | AD-9549 |
| 1820-1838 | GGGcccAcAAcGcuuuuGGTsT | 647 | CcAAAAGCGUUGUGGGCCCTsT | 648 | AD-9675 |
| 1840-1858 | GGUGAGGGUGUCUACGCCATsT | 649 | UGGCGUAGACACCCUCACCTsT | 650 | AD-9541 |
| 1840-1858 | GGuGAGGGuGucuAcGccATsT | 651 | UGGCGUaGAcACCCUcACCTsT | 652 | AD-9667 |
| 1843-1861 | GAGGGUGUCUACGCCAUUGTsT | 653 | CAAUGGCGUAGACACCCUCTsT | 654 | AD-9550 |
| 1843-1861 | GAGGGuGucuAcGccAuuGTsT | 655 | cAAUGGCGUaGAcACCCUCTsT | 656 | AD-9676 |
| 1861-1879 | GCCAGGUGCUGCCUGCUACTsT | 657 | GUAGCAGGCAGCACCUGGCTsT | 658 | AD-9571 |
| 1861-1879 | GccAGGuGcuGccuGcuAcTsT | 659 | GuAGcAGGcAGcACCUGGCTsT | 660 | AD-9697 |
| 1862-1880 | CCAGGUGCUGCCUGCUACCTsT | 661 | GGUAGCAGGCAGCACCUGGTsT | 662 | AD-9572 |
| 1862-1880 | ccAGGuGcuGccuGcuAccTsT | 663 | GGuAGcAGGcAGcACCUGGTsT | 664 | AD-9698 |
| 2008-2026 | ACCCACAAGCCGCCUGUGCTT | 665 | GCACAGGCGGCUUGUGGGUTT | 666 | AD-15327 |
| 2023-2041 | GUGCUGAGGCCACGAGGUCTsT | 667 | GACCUCGUGGCCUCAGCACTsT | 668 | AD-9639 |
| 2023-2041 | GuGcuGAGGccAcGAGGucTsT | 669 | GACCUCGUGGCCUcAGcACTsT | 670 | AD-9765 |
| 2024-2042 | UGCUGAGGCCACGAGGUCATsT | 671 | UGACCUCGUGGCCUCAGCATsT | 672 | AD-9518 |
| 2024-2042 | UGCUGAGGCCACGAGGUCATsT | 673 | UGACCUCGUGGCCUCAGCATsT | 674 | AD-9518 |
| 2024-2042 | uGcuGAGGccAcGAGGucATsT | 675 | UGACCUCGUGGCCUcAGcATsT | 676 | AD-9644 |
| 2024-2042 | UfgCfuGfaGfgCfcAfcGfaGfgUfcAfTsT | 677 | p-uGfaCfcUfcGfuGfgCfcUfcAfgCfaTsT | 678 | AD-14672 |
| 2024-2042 | UfGCfUfGfAGGCfCfACfgAGGUfCfATsT | 679 | UfgACfCfUfCfGUfGGCfCfUfCfAGCfATsT | 680 | AD-14682 |
| 2024-2042 | UgCuGaGgCcAcGaGgUcATsT | 681 | p-uGfaCfcUfcGfuGfgCfcUfcAfgCfaTsT | 682 | AD-14692 |
| 2024-2042 | UgCuGaGgCcAcGaGgUcATsT | 683 | UfGACfCfUfCfGUfGGCfCfUfCfAGCfATsT | 684 | AD-14702 |
| 2024-2042 | UfgCfuGfaGfgCfcAfcGfaGfgUfcAfTsT | 685 | UGACCucGUggCCUCAgcaTsT | 686 | AD-14712 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2024-2042 | UfGCfUfGAGGCfCfACfGAGGUfCfATsT | 687 | UGACCucGUggCCUCAgcaTsT | 688 | AD-14722 |
| 2024-2042 | UgCuGaGgCcAcGaGgUcATsT | 689 | UGACCucGUggCCUCAgcaTsT | 690 | AD-14732 |
| 2024-2042 | GfuGfgUfcAfgCfgGfcCfgGfgAfuGfTsT | 691 | p-cAfuCfcCfgGfcCfgCfuGfaCfcAfcTsT | 692 | AD-15078 |
| 2024-2042 | GUfGGUfCfAGCfGGCfCfGGGAUfGTsT | 693 | CfAUfCfCfCfGGCfCfGCfUfGACfCfACfTsT | 694 | AD-15088 |
| 2024-2042 | GuGgUcAgCgGcCgGgAuGTsT | 695 | p-cAfuCfcCfgGfcCfgCfuGfaCfcAfcTsT | 696 | AD-15098 |
| 2024-2042 | GuGgUcAgCgGcCgGgAuGTsT | 697 | CfAUfCfCfCfGGCfCfGCfUfGACfCfACfTsT | 698 | AD-15108 |
| 2024-2042 | GfuGfgUfcAfgCfgGfcCfgGfgAfuGfTsT | 699 | CAUCCcgGCcgCUGACcacTsT | 700 | AD-15118 |
| 2024-2042 | GUfGGUfCfAGCfGGCfCfGGGAUfGTsT | 701 | CAUCCcgGCcgCUGACcacTsT | 702 | AD-15128 |
| 2024-2042 | GuGgUcAgCgGcCgGgAuGTsT | 703 | CAUCCcgGCcgCUGACcacTsT | 704 | AD-15138 |
| 2030-2048 | GGCCACGAGGUCAGCCCAATT | 705 | UUGGGCUGACCUCGUGGCCTT | 706 | AD-15237 |
| 2035-2053 | CGAGGUCAGCCCAACCAGUTT | 707 | ACUGGUUGGGCUGACCUCGTT | 708 | AD-15287 |
| 2039-2057 | GUCAGCCCAACCAGUGCGUTT | 709 | ACGCACUGGUUGGGCUGACTT | 710 | AD-15238 |
| 2041-2059 | CAGCCCAACCAGUGCGUGGTT | 711 | CCACGCACUGGUUGGGCUGTT | 712 | AD-15328 |
| 2062-2080 | CACAGGGAGGCCAGCAUCCTT | 713 | GGAUGCUGGCCUCCCUGUGTT | 714 | AD-15399 |
| 2072-2090 | CCAGCAUCCACGCUUCCUGTsT | 715 | CAGGAAGCGUGGAUGCUGGTsT | 716 | AD-9582 |
| 2072-2090 | ccAGcAuccAcGcuuccuGTsT | 717 | cAGGAAGCGUGGAUGCUGGTsT | 718 | AD-9708 |
| 2118-2136 | AGUCAAGGAGCAUGGAAUCTsT | 719 | GAUUCCAUGCUCCUUGACUTsT | 720 | AD-9545 |
| 2118-2136 | AGucAAGGAGcAuGGAAucTsT | 721 | GAUUCcAUGCUCCUUGACUTsT | 722 | AD-9671 |
| 2118-2136 | AfgUfcAfaGfgAfgCfaUfgGfaAfuCfTsT | 723 | p-gAfuUfcCfaUfgCfuCfcUfuGfaCfuTsT | 724 | AD-14674 |
| 2118-2136 | AGUfCfAAGGAGCfAUfGGAAUfCfTsT | 725 | GAUfUfCfCfAUfGCfUfCfCfUfUfGACfUfTsT | 726 | AD-14684 |
| 2118-2136 | AgUcAaGgAgCaUgGaAuCTsT | 727 | p-gAfuUfcCfaUfgCfuCfcUfuGfaCfuTsT | 728 | AD-14694 |
| 2118-2136 | AgUcAaGgAgCaUgGaAuCTsT | 729 | GAUfUfCfCfAUfGCfUfCfCfUfUfGACfUfTsT | 730 | AD-14704 |
| 2118-2136 | AfgUfcAfaGfgAfgCfaUfgGfaAfuCfTsT | 731 | GAUUCcaUGcuCCUUGacuTsT | 732 | AD-14714 |
| 2118-2136 | AGUfCfAAGGAGCfAUfGGAAUfCfTsT | 733 | GAUUCcaUGcuCCUUGacuTsT | 734 | AD-14724 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2118-2136 | AgUcAaGgAgCaUgGaAuCTsT | 735 | GAUUCcaUGcuCCUUGacuTsT | 736 | AD-14734 |
| 2118-2136 | GfcGfgCfaCfcCfuCfaUfaGfgCfcUfTsT | 737 | p-aGfgCfcUfaUfgAfgGfgUfgCfcGfcTsT | 738 | AD-15080 |
| 2118-2136 | GCfGGCfACfCfCfUfCfAUfAGGCfCfUfTsT | 739 | AGGCfCfUfAUfGAGGGUfGCfCfGCfTsT | 740 | AD-15090 |
| 2118-2136 | GcGgCaCcCuCaUaGgCcUTsT | 741 | p-aGfgCfcUfaUfgAfgGfgUfgCfcGfcTsT | 742 | AD-15100 |
| 2118-2136 | GcGgCaCcCuCaUaGgCcUTsT | 743 | AGGCfCfUfAUfGAGGGUfGCfCfGCfTsT | 744 | AD-15110 |
| 2118-2136 | GfcGfgCfaCfcCfuCfaUfaGfgCfcUfTsT | 745 | AGGCCuaUGagGGUGCcgcTsT | 746 | AD-15120 |
| 2118-2136 | GCfGGCfACfCfCfUfCfAUfAGGCfCfUfTsT | 747 | AGGCCuaUGagGGUGCcgcTsT | 748 | AD-15130 |
| 2118-2136 | GcGgCaCcCuCaUaGgCcUTsT | 749 | AGGCCuaUGagGGUGCcgcTsT | 750 | AD-15140 |
| 2122-2140 | AAGGAGCAUGGAAUCCCGGTsT | 751 | CCGGGAUUCCAUGCUCCUUTsT | 752 | AD-9522 |
| 2122-2140 | AAGGAGcAuGGAAucccGGTsT | 753 | CCGGGAUUCcAUGCUCCUUTsT | 754 | AD-9648 |
| 2123-2141 | AGGAGCAUGGAAUCCCGGCTsT | 755 | GCCGGGAUUCCAUGCUCCUTsT | 756 | AD-9552 |
| 2123-2141 | AGGAGcAuGGAAucccGGcTsT | 757 | GCCGGGAUUCcAUGCUCCUTsT | 758 | AD-9678 |
| 2125-2143 | GAGCAUGGAAUCCCGGCCCTsT | 759 | GGGCCGGGAUUCCAUGCUCTsT | 760 | AD-9618 |
| 2125-2143 | GAGcAuGGAAucccGGcccTsT | 761 | GGGCCGGGAUUCcAUGCUCTsT | 762 | AD-9744 |
| 2230-2248 | GCCUACGCCGUAGACAACATT | 763 | UGUUGUCUACGGCGUAGGCTT | 764 | AD-15239 |
| 2231-2249 | CCUACGCCGUAGACAACACTT | 765 | GUGUUGUCUACGGCGUAGGTT | 766 | AD-15212 |
| 2232-2250 | CUACGCCGUAGACAACACGTT | 767 | CGUGUUGUCUACGGCGUAGTT | 768 | AD-15240 |
| 2233-2251 | UACGCCGUAGACAACACGUTT | 769 | ACGUGUUGUCUACGGCGUATT | 770 | AD-15177 |
| 2235-2253 | CGCCGUAGACAACACGUGUTT | 771 | ACACGUGUUGUCUACGGCGTT | 772 | AD-15179 |
| 2236-2254 | GCCGUAGACAACACGUGUGTT | 773 | CACACGUGUUGUCUACGGCTT | 774 | AD-15180 |
| 2237-2255 | CCGUAGACAACACGUGUGUTT | 775 | ACACACGUGUUGUCUACGGTT | 776 | AD-15241 |
| 2238-2256 | CGUAGACAACACGUGUGUATT | 777 | UACACACGUGUUGUCUACGTT | 778 | AD-15268 |
| 2240-2258 | UAGACAACACGUGUGUAGUTT | 779 | ACUACACACGUGUUGUCUATT | 780 | AD-15242 |
| 2241-2259 | AGACAACACGUGUGUAGUCTT | 781 | GACUACACACGUGUUGUCUTT | 782 | AD-15216 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2242-2260 | GACAACACGUGUGUAGUCAUU | 783 | UGACUACACACGUGUUGUCUU | 784 | AD-15176 |
| 2243-2261 | ACAACACGUGUGUAGUCAGUU | 785 | CUGACUACACACGUGUUGUUU | 786 | AD-15181 |
| 2244-2262 | CAACACGUGUGUAGUCAGGUU | 787 | CCUGACUACACACGUGUUGUU | 788 | AD-15243 |
| 2247-2265 | CACGUGUGUAGUCAGGAGCUU | 789 | GCUCCUGACUACACACGUGUU | 790 | AD-15182 |
| 2248-2266 | ACGUGUGUAGUCAGGAGCCUU | 791 | GGCUCCUGACUACACACGUUU | 792 | AD-15244 |
| 2249-2267 | CGUGUGUAGUCAGGAGCCGUU | 793 | CGGCUCCUGACUACACACGUU | 794 | AD-15387 |
| 2251-2269 | UGUGUAGUCAGGAGCCGGGUU | 795 | CCCGGCUCCUGACUACACAUU | 796 | AD-15245 |
| 2257-2275 | GUCAGGAGCCGGGACGUCATsT | 797 | UGACGUCCCGGCUCCUGACTsT | 798 | AD-9555 |
| 2257-2275 | GucAGGAGccGGGAcGucATsT | 799 | UGACGUCCCGGCUCCUGACTsT | 800 | AD-9681 |
| 2258-2276 | UCAGGAGCCGGGACGUCAGTsT | 801 | CUGACGUCCCGGCUCCUGATsT | 802 | AD-9619 |
| 2258-2276 | ucAGGAGccGGGAcGucAGTsT | 803 | CUGACGUCCCGGCUCCUGATsT | 804 | AD-9745 |
| 2259-2277 | CAGGAGCCGGGACGUCAGCTsT | 805 | GCUGACGUCCCGGCUCCUGTsT | 806 | AD-9620 |
| 2259-2277 | cAGGAGccGGGAcGucAGcTsT | 807 | GCUGACGUCCCGGCUCCUGTsT | 808 | AD-9746 |
| 2263-2281 | AGCCGGGACGUCAGCACUAUU | 809 | UAGUGCUGACGUCCCGGCUUU | 810 | AD-15288 |
| 2265-2283 | CCGGGACGUCAGCACUACAUU | 811 | UGUAGUGCUGACGUCCCGGUU | 812 | AD-15246 |
| 2303-2321 | CCGUGACAGCCGUUGCCAUUU | 813 | AUGGCAACGGCUGUCACGGUU | 814 | AD-15289 |
| 2317-2335 | GCCAUCUGCUGCCGGAGCCTsT | 815 | GGCUCCGGCAGCAGAUGGCTsT | 816 | AD-9324 |
| 2375-2393 | CCCAUCCCAGGAUGGGUGUUU | 817 | ACACCCAUCCUGGGAUGGGUU | 818 | AD-15329 |
| 2377-2395 | CAUCCCAGGAUGGGUGUCUU | 819 | AGACACCCAUCCUGGGAUGUU | 820 | AD-15330 |
| 2420-2438 | AGCUUUAAAAUGGUUCCGAUU | 821 | UCGGAACCAUUUUAAAGCUUU | 822 | AD-15169 |
| 2421-2439 | GCUUUAAAAUGGUUCCGACUU | 823 | GUCGGAACCAUUUUAAAGCUU | 824 | AD-15201 |
| 2422-2440 | CUUUAAAAUGGUUCCGACUUU | 825 | AGUCGGAACCAUUUUAAAGUU | 826 | AD-15331 |
| 2423-2441 | UUUAAAAUGGUUCCGACUUUU | 827 | AAGUCGGAACCAUUUUAAAUU | 828 | AD-15190 |
| 2424-2442 | UUAAAAUGGUUCCGACUUGUU | 829 | CAAGUCGGAACCAUUUUAAUU | 830 | AD-15247 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2425-2443 | UAAAAUGGUUCCGACUUGUTT | 831 | ACAAGUCGGAACCAUUUUATT | 832 | AD-15248 |
| 2426-2444 | AAAAUGGUUCCGACUUGUCTT | 833 | GACAAGUCGGAACCAUUUUTT | 834 | AD-15175 |
| 2427-2445 | AAAUGGUUCCGACUUGUCCTT | 835 | GGACAAGUCGGAACCAUUUTT | 836 | AD-15249 |
| 2428-2446 | AAUGGUUCCGACUUGUCCCTT | 837 | GGGACAAGUCGGAACCAUUTT | 838 | AD-15250 |
| 2431-2449 | GGUUCCGACUUGUCCCUCUTT | 839 | AGAGGGACAAGUCGGAACCTT | 840 | AD-15400 |
| 2457-2475 | CUCCAUGGCCUGGCACGAGTT | 841 | CUCGUGCCAGGCCAUGGAGTT | 842 | AD-15332 |
| 2459-2477 | CCAUGGCCUGGCACGAGGGTT | 843 | CCCUCGUGCCAGGCCAUGGTT | 844 | AD-15388 |
| 2545-2563 | GAACUCACUCACUCUGGGUTT | 845 | ACCCAGAGUGAGUGAGUUCTT | 846 | AD-15333 |
| 2549-2567 | UCACUCACUCUGGGUGCCUTT | 847 | AGGCACCCAGAGUGAGUGATT | 848 | AD-15334 |
| 2616-2634 | UUUCACCAUUCAAACAGGUTT | 849 | ACCUGUUUGAAUGGUGAAATT | 850 | AD-15335 |
| 2622-2640 | CAUUCAAACAGGUCGAGCUTT | 851 | AGCUCGACCUGUUUGAAUGTT | 852 | AD-15183 |
| 2623-2641 | AUUCAAACAGGUCGAGCUGTT | 853 | CAGCUCGACCUGUUUGAAUTT | 854 | AD-15202 |
| 2624-2642 | UUCAAACAGGUCGAGCUGUTT | 855 | ACAGCUCGACCUGUUUGAATT | 856 | AD-15203 |
| 2625-2643 | UCAAACAGGUCGAGCUGUGTT | 857 | CACAGCUCGACCUGUUUGATT | 858 | AD-15272 |
| 2626-2644 | CAAACAGGUCGAGCUGUGCTT | 859 | GCACAGCUCGACCUGUUUGTT | 860 | AD-15217 |
| 2627-2645 | AAACAGGUCGAGCUGUGCUTT | 861 | AGCACAGCUCGACCUGUUUTT | 862 | AD-15290 |
| 2628-2646 | AACAGGUCGAGCUGUGCUCTT | 863 | GAGCACAGCUCGACCUGUUTT | 864 | AD-15218 |
| 2630-2648 | CAGGUCGAGCUGUGCUCGGTT | 865 | CCGAGCACAGCUCGACCUGTT | 866 | AD-15389 |
| 2631-2649 | AGGUCGAGCUGUGCUCGGGTT | 867 | CCCGAGCACAGCUCGACCUTT | 868 | AD-15336 |
| 2633-2651 | GUCGAGCUGUGCUCGGGUGTT | 869 | CACCCGAGCACAGCUCGACTT | 870 | AD-15337 |
| 2634-2652 | UCGAGCUGUGCUCGGGUGCTT | 871 | GCACCCGAGCACAGCUCGATT | 872 | AD-15191 |
| 2657-2675 | AGCUGCUCCCAAUGUGCCGTT | 873 | CGGCACAUUGGGAGCAGCUTT | 874 | AD-15390 |
| 2658-2676 | GCUGCUCCCAAUGUGCCGATT | 875 | UCGGCACAUUGGGAGCAGCTT | 876 | AD-15338 |
| 2660-2678 | UGCUCCCAAUGUGCCGAUGTT | 877 | CAUCGGCACAUUGGGAGCATT | 878 | AD-15204 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2663-2681 | UCCCAAUGUGCCGAUGUCCUTT | 879 | GGACAUCGGCACAUUGGGATT | 880 | AD-15251 |
| 2665-2683 | CCAAUGUGCCGAUGUCCGUTT | 881 | ACGGACAUCGGCACAUUGGTT | 882 | AD-15205 |
| 2666-2684 | CAAUGUGCCGAUGUCCGUGTT | 883 | CACGGACAUCGGCACAUUGTT | 884 | AD-15171 |
| 2667-2685 | AAUGUGCCGAUGUCCGUGGTT | 885 | CCACGGACAUCGGCACAUUTT | 886 | AD-15252 |
| 2673-2691 | CCGAUGUCCGUGGGCAGAATT | 887 | UUCUGCCCACGGACAUCGGTT | 888 | AD-15339 |
| 2675-2693 | GAUGUCCGUGGGCAGAAUGTT | 889 | CAUUCUGCCCACGGACAUCTT | 890 | AD-15253 |
| 2678-2696 | GUCCGUGGGCAGAAUGACUTT | 891 | AGUCAUUCUGCCCACGGACTT | 892 | AD-15340 |
| 2679-2697 | UCCGUGGGCAGAAUGACUUTT | 893 | AAGUCAUUCUGCCCACGGATT | 894 | AD-15291 |
| 2683-2701 | UGGGCAGAAUGACUUUUAUTT | 895 | AUAAAAGUCAUUCUGCCCATT | 896 | AD-15341 |
| 2694-2712 | ACUUUUAUUGAGCUCUUGUTT | 897 | ACAAGAGCUCAAUAAAAGUTT | 898 | AD-15401 |
| 2700-2718 | AUUGAGCUCUUGUUCCGUGTT | 899 | CACGGAACAAGAGCUCAAUTT | 900 | AD-15342 |
| 2704-2722 | AGCUCUUGUUCCGUGCCAGTT | 901 | CUGGCACGGAACAAGAGCUTT | 902 | AD-15343 |
| 2705-2723 | GCUCUUGUUCCGUGCCAGGTT | 903 | CCUGGCACGGAACAAGAGCTT | 904 | AD-15292 |
| 2710-2728 | UGUUCCGUGCCAGGCAUUCTT | 905 | GAAUGCCUGGCACGGAACATT | 906 | AD-15344 |
| 2711-2729 | GUUCCGUGCCAGGCAUUCATT | 907 | UGAAUGCCUGGCACGGAACTT | 908 | AD-15254 |
| 2712-2730 | UUCCGUGCCAGGCAUUCAATT | 909 | UUGAAUGCCUGGCACGGAATT | 910 | AD-15345 |
| 2715-2733 | CGUGCCAGGCAUUCAAUCCTT | 911 | GGAUUGAAUGCCUGGCACGTT | 912 | AD-15206 |
| 2716-2734 | GUGCCAGGCAUUCAAUCCUTT | 913 | AGGAUUGAAUGCCUGGCACTT | 914 | AD-15346 |
| 2728-2746 | CAAUCCUCAGGUCUCCACCTT | 915 | GGUGGAGACCUGAGGAUUGTT | 916 | AD-15347 |
| 2743-2761 | CACCAAGGAGGCAGGAUUCTsT | 917 | GAAUCCUGCCUCCUUGGUGTsT | 918 | AD-9577 |
| 2743-2761 | cAccAAGGAGGcAGGAuucTsT | 919 | GAAUCCUGCCUCCUUGGUGTsT | 920 | AD-9703 |
| 2743-2761 | CfaCfcAfaGfgAfgGfcAfgGfaUfuCfTsT | 921 | p-gAfaUfcCfuGfcCfuCfcUfuGfgUfgTsT | 922 | AD-14678 |
| 2743-2761 | CfACfCfAAGGAGGCfAGGAUfUfCfTsT | 923 | GAAUfCfCfUfGCfCfUfCfCfUfUfGGUfGTsT | 924 | AD-14688 |
| 2743-2761 | CaCcAaGgAgGcAgGaUuCTsT | 925 | p-gAfaUfcCfuGfcCfuCfcUfuGfgUfgTsT | 926 | AD-14698 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2743-2761 | CaCcAaGgAgGcAgGaUuCTsT | 927 | GAAUfCfCfUfGCfCfUfCfCfUfUfGGUfG TsT | 928 | AD-14708 |
| 2743-2761 | CfaCfcAfaGfgAfgGfcAfgGfaUfuC fTsT | 929 | GAAUCcuGCcuCCUUGgugTsT | 930 | AD-14718 |
| 2743-2761 | CfACfCfAAGGAGGCfAGGAUfUfCfTsT | 931 | GAAUCcuGCcuCCUUGgugTsT | 932 | AD-14728 |
| 2743-2761 | CaCcAaGgAgGcAgGaUuCTsT | 933 | GAAUCcuGCcuCCUUGgugTsT | 934 | AD-14738 |
| 2743-2761 | GfgCfcUfgGfaGfuUfuAfuUfcGfgA fTsT | 935 | p-uCfcGfaAfuAfaAfcUfcCfaGfgCfcTsT | 936 | AD-15084 |
| 2743-2761 | GGCfCfUfGGAGUfUfUfAUfUfCfGGA TsT | 937 | UfCfCfGAAUfAAACfUfCfCfAGGCfCfTsT | 938 | AD-15094 |
| 2743-2761 | GgCcUgGaGuUuAuUcGgATsT | 939 | p-uCfcGfaAfuAfaAfcUfcCfaGfgCfcTsT | 940 | AD-15104 |
| 2743-2761 | GgCcUgGaGuUuAuUcGgATsT | 941 | UfCfCfGAAUfAAACfUfCfCfAGGCfCfTsT | 942 | AD-15114 |
| 2743-2761 | GfgCfcUfgGfaGfuUfuAfuUfcGfgA fTsT | 943 | UCCGAauAAacUCCAGgccTsT | 944 | AD-15124 |
| 2743-2761 | GGCfCfUfGGAGUfUfUfAUfUfCfGGA TsT | 945 | UCCGAauAAacUCCAGgccTsT | 946 | AD-15134 |
| 2743-2761 | GgCcUgGaGuUuAuUcGgATsT | 947 | UCCGAauAAacUCCAGgccTsT | 948 | AD-15144 |
| 2753-2771 | GCAGGAUUCUUCCCAUGGATT | 949 | UCCAUGGGAAGAAUCCUGCTT | 950 | AD-15391 |
| 2794-2812 | UGCAGGGACAAACAUCGUUTT | 951 | AACGAUGUUUGUCCCUGCATT | 952 | AD-15348 |
| 2795-2813 | GCAGGGACAAACAUCGUUGTT | 953 | CAACGAUGUUUGUCCCUGCTT | 954 | AD-15349 |
| 2797-2815 | AGGGACAAACAUCGUUGGGTT | 955 | CCCAACGAUGUUUGUCCCUTT | 956 | AD-15170 |
| 2841-2859 | CCCUCAUCUCCAGCUAACUTT | 957 | AGUUAGCUGGAGAUGAGGGTT | 958 | AD-15350 |
| 2845-2863 | CAUCUCCAGCUAACUGUGGTT | 959 | CCACAGUUAGCUGGAGAUGTT | 960 | AD-15402 |
| 2878-2896 | GCUCCCUGAUUAAUGGAGGTT | 961 | CCUCCAUUAAUCAGGGAGCTT | 962 | AD-15293 |
| 2881-2899 | CCCUGAUUAAUGGAGGCUUTT | 963 | AAGCCUCCAUUAAUCAGGGTT | 964 | AD-15351 |
| 2882-2900 | CCUGAUUAAUGGAGGCUUATT | 965 | UAAGCCUCCAUUAAUCAGGTT | 966 | AD-15403 |
| 2884-2902 | UGAUUAAUGGAGGCUUAGCTT | 967 | GCUAAGCCUCCAUUAAUCATT | 968 | AD-15404 |
| 2885-2903 | GAUUAAUGGAGGCUUAGCUTT | 969 | AGCUAAGCCUCCAUUAAUCTT | 970 | AD-15207 |
| 2886-2904 | AUUAAUGGAGGCUUAGCUUTT | 971 | AAGCUAAGCCUCCAUUAAUTT | 972 | AD-15352 |
| 2887-2905 | UUAAUGGAGGCUUAGCUUUTT | 973 | AAAGCUAAGCCUCCAUUAATT | 974 | AD-15255 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 2903-2921 | UUUCUGGAUGGCAUCUAGCTsT | 975 | GCUAGAUGCCAUCCAGAAATsT | 976 | AD-9603 |
| 2903-2921 | uuucuGGAuGGcAucuAGcTsT | 977 | GCuAGAUGCcAUCcAGAAATsT | 978 | AD-9729 |
| 2904-2922 | UUCUGGAUGGCAUCUAGCCTsT | 979 | GGCUAGAUGCCAUCCAGAATsT | 980 | AD-9599 |
| 2904-2922 | uucuGGAuGGcAucuAGccTsT | 981 | GGCuAGAUGCcAUCcAGAATsT | 982 | AD-9725 |
| 2905-2923 | UCUGGAUGGCAUCUAGCCATsT | 983 | UGGCUAGAUGCCAUCCAGATsT | 984 | AD-9621 |
| 2905-2923 | ucuGGAuGGcAucuAGccATsT | 985 | UGGCuAGAUGCcAUCcAGATsT | 986 | AD-9747 |
| 2925-2943 | AGGCUGGAGACAGGUGCGCTT | 987 | GCGCACCUGUCUCCAGCCUTT | 988 | AD-15405 |
| 2926-2944 | GGCUGGAGACAGGUGCGCCTT | 989 | GGCGCACCUGUCUCCAGCCTT | 990 | AD-15353 |
| 2927-2945 | GCUGGAGACAGGUGCGCCCTT | 991 | GGGCGCACCUGUCUCCAGCTT | 992 | AD-15354 |
| 2972-2990 | UUCCUGAGCCACCUUUACUTT | 993 | AGUAAAGGUGGCUCAGGAATT | 994 | AD-15406 |
| 2973-2991 | UCCUGAGCCACCUUUACUCTT | 995 | GAGUAAAGGUGGCUCAGGATT | 996 | AD-15407 |
| 2974-2992 | CCUGAGCCACCUUUACUCUTT | 997 | AGAGUAAAGGUGGCUCAGGTT | 998 | AD-15355 |
| 2976-2994 | UGAGCCACCUUUACUCUGCTT | 999 | GCAGAGUAAAGGUGGCUCATT | 1000 | AD-15356 |
| 2978-2996 | AGCCACCUUUACUCUGCUCTT | 1001 | GAGCAGAGUAAAGGUGGCUTT | 1002 | AD-15357 |
| 2981-2999 | CACCUUUACUCUGCUCUAUTT | 1003 | AUAGAGCAGAGUAAAGGUGTT | 1004 | AD-15269 |
| 2987-3005 | UACUCUGCUCUAUGCCAGGTsT | 1005 | CCUGGCAUAGAGCAGAGUATsT | 1006 | AD-9565 |
| 2987-3005 | uAcucuGcucuAuGccAGGTsT | 1007 | CCUGGcAuAGAGcAGAGuATsT | 1008 | AD-9691 |
| 2998-3016 | AUGCCAGGCUGUGCUAGCATT | 1009 | UGCUAGCACAGCCUGGCAUTT | 1010 | AD-15358 |
| 3003-3021 | AGGCUGUGCUAGCAACACCTT | 1011 | GGUGUUGCUAGCACAGCCUTT | 1012 | AD-15359 |
| 3006-3024 | CUGUGCUAGCAACACCCAATT | 1013 | UUGGGUGUUGCUAGCACAGTT | 1014 | AD-15360 |
| 3010-3028 | GCUAGCAACACCCAAAGGUTT | 1015 | ACCUUUGGGUGUUGCUAGCTT | 1016 | AD-15219 |
| 3038-3056 | GGAGCCAUCACCUAGGACUTT | 1017 | AGUCCUAGGUGAUGGCUCCTT | 1018 | AD-15361 |
| 3046-3064 | CACCUAGGACUGACUCGGCTT | 1019 | GCCGAGUCAGUCCUAGGUGTT | 1020 | AD-15273 |
| 3051-3069 | AGGACUGACUCGGCAGUGUTT | 1021 | ACACUGCCGAGUCAGUCCUTT | 1022 | AD-15362 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 3052-3070 | GGACUGACUCGGCAGUGUGTT | 1023 | CACACUGCCGAGUCAGUCCTT | 1024 | AD-15192 |
| 3074-3092 | UGGUGCAUGCACUGUCUCATT | 1025 | UGAGACAGUGCAUGCACCATT | 1026 | AD-15256 |
| 3080-3098 | AUGCACUGUCUCAGCCAACTT | 1027 | GUUGGCUGAGACAGUGCAUTT | 1028 | AD-15363 |
| 3085-3103 | CUGUCUCAGCCAACCCGCUTT | 1029 | AGCGGGUUGGCUGAGACAGTT | 1030 | AD-15364 |
| 3089-3107 | CUCAGCCAACCCGCUCCACTsT | 1031 | GUGGAGCGGGUUGGCUGAGTsT | 1032 | AD-9604 |
| 3089-3107 | cucAGccAAcccGcuccAcTsT | 1033 | GUGGAGCGGGUUGGCUGAGTsT | 1034 | AD-9730 |
| 3093-3111 | GCCAACCCGCUCCACUACCTsT | 1035 | GGUAGUGGAGCGGGUUGGCTsT | 1036 | AD-9527 |
| 3093-3111 | GccAAcccGcuccAcuAccTsT | 1037 | GGuAGUGGAGCGGGUUGGCTsT | 1038 | AD-9653 |
| 3096-3114 | AACCCGCUCCACUACCCGGTT | 1039 | CCGGGUAGUGGAGCGGGUUTT | 1040 | AD-15365 |
| 3099-3117 | CCGCUCCACUACCCGGCAGTT | 1041 | CUGCCGGGUAGUGGAGCGGTT | 1042 | AD-15294 |
| 3107-3125 | CUACCCGGCAGGGUACACATT | 1043 | UGUGUACCCUGCCGGGUAGTT | 1044 | AD-15173 |
| 3108-3126 | UACCCGGCAGGGUACACAUTT | 1045 | AUGUGUACCCUGCCGGGUATT | 1046 | AD-15366 |
| 3109-3127 | ACCCGGCAGGGUACACAUUTT | 1047 | AAUGUGUACCCUGCCGGGUTT | 1048 | AD-15367 |
| 3110-3128 | CCCGGCAGGGUACACAUUCTT | 1049 | GAAUGUGUACCCUGCCGGGTT | 1050 | AD-15257 |
| 3112-3130 | CGGCAGGGUACACAUUCGCTT | 1051 | GCGAAUGUGUACCCUGCCGTT | 1052 | AD-15184 |
| 3114-3132 | GCAGGGUACACAUUCGCACTT | 1053 | GUGCGAAUGUGUACCCUGCTT | 1054 | AD-15185 |
| 3115-3133 | CAGGGUACACAUUCGCACCTT | 1055 | GGUGCGAAUGUGUACCCUGTT | 1056 | AD-15258 |
| 3116-3134 | AGGGUACACAUUCGCACCCTT | 1057 | GGGUGCGAAUGUGUACCCUTT | 1058 | AD-15186 |
| 3196-3214 | GGAACUGAGCCAGAAACGCTT | 1059 | GCGUUUCUGGCUCAGUUCCTT | 1060 | AD-15274 |
| 3197-3215 | GAACUGAGCCAGAAACGCATT | 1061 | UGCGUUUCUGGCUCAGUUCTT | 1062 | AD-15368 |
| 3198-3216 | AACUGAGCCAGAAACGCAGTT | 1063 | CUGCGUUUCUGGCUCAGUUTT | 1064 | AD-15369 |
| 3201-3219 | UGAGCCAGAAACGCAGAUUTT | 1065 | AAUCUGCGUUUCUGGCUCATT | 1066 | AD-15370 |
| 3207-3225 | AGAAACGCAGAUUGGGCUGTT | 1067 | CAGCCCAAUCUGCGUUUCUTT | 1068 | AD-15259 |
| 3210-3228 | AACGCAGAUUGGGCUGGCUTT | 1069 | AGCCAGCCCAAUCUGCGUUTT | 1070 | AD-15408 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 3233-3251 | AGCCAAGCCUCUUCUUACUTsT | 1071 | AGUAAGAAGAGGCUUGGCUTsT | 1072 | AD-9597 |
| 3233-3251 | AGccAAGccucuucuuAcuTsT | 1073 | AGuAAGAAGAGGCUUGGCUTsT | 1074 | AD-9723 |
| 3233-3251 | AfgCfcAfaGfcCfuCfuUfcUfuAfcUfTsT | 1075 | p-aGfuAfaGfaAfgAfgGfcUfuGfgCfuTsT | 1076 | AD-14680 |
| 3233-3251 | AGCfCfAAGCfCfUfCfUfUfCfUfUfACfUfTsT | 1077 | AGUfAAGAAGAGGCfUfUfGGCfUfTsT | 1078 | AD-14690 |
| 3233-3251 | AgCcAaGcCuCuUcUuAcUTsT | 1079 | p-aGfuAfaGfaAfgAfgGfcUfuGfgCfuTsT | 1080 | AD-14700 |
| 3233-3251 | AgCcAaGcCuCuUcUuAcUTsT | 1081 | AGUfAAGAAGAGGCfUfUfGGCfUfTsT | 1082 | AD-14710 |
| 3233-3251 | AfgCfcAfaGfcCfuCfuUfcUfuAfcUfTsT | 1083 | AGUAAgaAGagGCUUGgcuTsT | 1084 | AD-14720 |
| 3233-3251 | AGCfCfAAGCfCfUfCfUfUfCfUfUfACfUfTsT | 1085 | AGUAAgaAGagGCUUGgcuTsT | 1086 | AD-14730 |
| 3233-3251 | AgCcAaGcCuCuUcUuAcUTsT | 1087 | AGUAAgaAGagGCUUGgcuTsT | 1088 | AD-14740 |
| 3233-3251 | UfgGfuUfcCfcUfgAfgGfaCfcAfgCfTsT | 1089 | p-gCfuGfgUfcCfuCfaGfgGfaAfcCfaTsT | 1090 | AD-15086 |
| 3233-3251 | UfGGUfUfCfCfCfUfGAGGACfCfAGCfTsT | 1091 | GCfUfGGUfCfCfUfCfAGGGAACfCfATsT | 1092 | AD-15096 |
| 3233-3251 | UgGuUcCcUgAgGaCcAgCTsT | 1093 | p-gCfuGfgUfcCfuCfaGfgGfaAfcCfaTsT | 1094 | AD-15106 |
| 3233-3251 | UgGuUcCcUgAgGaCcAgCTsT | 1095 | GCfUfGGUfCfCfUfCfAGGGAACfCfATsT | 1096 | AD-15116 |
| 3233-3251 | UfgGfuUfcCfcUfgAfgGfaCfcAfgCfTsT | 1097 | GCUGGucCUcaGGGAAccaTsT | 1098 | AD-15126 |
| 3233-3251 | UfGGUfUfCfCfCfUfGAGGACfCfAGCfTsT | 1099 | GCUGGucCUcaGGGAAccaTsT | 1100 | AD-15136 |
| 3233-3251 | UgGuUcCcUgAgGaCcAgCTsT | 1101 | GCUGGucCUcaGGGAAccaTsT | 1102 | AD-15146 |
| 3242-3260 | UCUUCUUACUUCACCCGGCTT | 1103 | GCCGGGUGAAGUAAGAAGATT | 1104 | AD-15260 |
| 3243-3261 | CUUCUUACUUCACCCGGCUTT | 1105 | AGCCGGGUGAAGUAAGAAGTT | 1106 | AD-15371 |
| 3244-3262 | UUCUUACUUCACCCGGCUGTT | 1107 | CAGCCGGGUGAAGUAAGAATT | 1108 | AD-15372 |
| 3262-3280 | GGGCUCCUCAUUUUUACGGTT | 1109 | CCGUAAAAAUGAGGAGCCCTT | 1110 | AD-15172 |
| 3263-3281 | GGCUCCUCAUUUUUACGGGTT | 1111 | CCCGUAAAAAUGAGGAGCCTT | 1112 | AD-15295 |
| 3264-3282 | GCUCCUCAUUUUUACGGGUTT | 1113 | ACCCGUAAAAAUGAGGAGCTT | 1114 | AD-15373 |
| 3265-3283 | CUCCUCAUUUUUACGGGUATT | 1115 | UACCCGUAAAAAUGAGGAGTT | 1116 | AD-15163 |
| 3266-3284 | UCCUCAUUUUUACGGGUAATT | 1117 | UUACCCGUAAAAAUGAGGATT | 1118 | AD-15165 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 3267-3285 | CCUCAUUUUUACGGGUAACUT | 1119 | GUUACCCGUAAAAAUGAGGTT | 1120 | AD-15374 |
| 3268-3286 | CUCAUUUUUACGGGUAACAUT | 1121 | UGUUACCCGUAAAAAUGAGTT | 1122 | AD-15296 |
| 3270-3288 | CAUUUUUACGGGUAACAGUTT | 1123 | ACUGUUACCCGUAAAAAUGTT | 1124 | AD-15261 |
| 3271-3289 | AUUUUUACGGGUAACAGUGTT | 1125 | CACUGUUACCCGUAAAAAUTT | 1126 | AD-15375 |
| 3274-3292 | UUUACGGGUAACAGUGAGGTT | 1127 | CCUCACUGUUACCCGUAAATT | 1128 | AD-15262 |
| 3308-3326 | CAGACCAGGAAGCUCGGUGTT | 1129 | CACCGAGCUUCCUGGUCUGTT | 1130 | AD-15376 |
| 3310-3328 | GACCAGGAAGCUCGGUGAGTT | 1131 | CUCACCGAGCUUCCUGGUCTT | 1132 | AD-15377 |
| 3312-3330 | CCAGGAAGCUCGGUGAGUGTT | 1133 | CACUCACCGAGCUUCCUGGTT | 1134 | AD-15409 |
| 3315-3333 | GGAAGCUCGGUGAGUGAUGTT | 1135 | CAUCACUCACCGAGCUUCCTT | 1136 | AD-15378 |
| 3324-3342 | GUGAGUGAUGGCAGAACGATT | 1137 | UCGUUCUGCCAUCACUCACTT | 1138 | AD-15410 |
| 3326-3344 | GAGUGAUGGCAGAACGAUGTT | 1139 | CAUCGUUCUGCCAUCACUCTT | 1140 | AD-15379 |
| 3330-3348 | GAUGGCAGAACGAUGCCUGTT | 1141 | CAGGCAUCGUUCUGCCAUCTT | 1142 | AD-15187 |
| 3336-3354 | AGAACGAUGCCUGCAGGCATT | 1143 | UGCCUGCAGGCAUCGUUCUTT | 1144 | AD-15263 |
| 3339-3357 | ACGAUGCCUGCAGGCAUGGTT | 1145 | CCAUGCCUGCAGGCAUCGUTT | 1146 | AD-15264 |
| 3348-3366 | GCAGGCAUGGAACUUUUUCTT | 1147 | GAAAAAGUUCCAUGCCUGCTT | 1148 | AD-15297 |
| 3356-3374 | GGAACUUUUUCCGUUAUCATT | 1149 | UGAUAACGGAAAAAGUUCCTT | 1150 | AD-15208 |
| 3357-3375 | GAACUUUUUCCGUUAUCACTT | 1151 | GUGAUAACGGAAAAAGUUCTT | 1152 | AD-15209 |
| 3358-3376 | AACUUUUUCCGUUAUCACCTT | 1153 | GGUGAUAACGGAAAAAGUUTT | 1154 | AD-15193 |
| 3370-3388 | UAUCACCCAGGCCUGAUUCTT | 1155 | GAAUCAGGCCUGGGUGAUATT | 1156 | AD-15380 |
| 3378-3396 | AGGCCUGAUUCACUGGCCUTT | 1157 | AGGCCAGUGAAUCAGGCCUTT | 1158 | AD-15298 |
| 3383-3401 | UGAUUCACUGGCCUGGCGGTT | 1159 | CCGCCAGGCCAGUGAAUCATT | 1160 | AD-15299 |
| 3385-3403 | AUUCACUGGCCUGGCGGAGTT | 1161 | CUCCGCCAGGCCAGUGAAUTT | 1162 | AD-15265 |
| 3406-3424 | GCUUCUAAGGCAUGGUCGGTT | 1163 | CCGACCAUGCCUUAGAAGCTT | 1164 | AD-15381 |
| 3407-3425 | CUUCUAAGGCAUGGUCGGGTT | 1165 | CCCGACCAUGCCUUAGAAGTT | 1166 | AD-15210 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 3429-3447 | GAGGGCCAACAACUGUCCCUU | 1167 | GGGACAGUUGUUGGCCCUCUU | 1168 | AD-15270 |
| 3440-3458 | ACUGUCCCUCCUUGAGCACTsT | 1169 | GUGCUCAAGGAGGGACAGUTsT | 1170 | AD-9591 |
| 3440-3458 | AcuGucccuccuuGAGcAcTsT | 1171 | GUGCUcAAGGAGGGAcAGUTsT | 1172 | AD-9717 |
| 3441-3459 | CUGUCCCUCCUUGAGCACCTsT | 1173 | GGUGCUCAAGGAGGGACAGTsT | 1174 | AD-9622 |
| 3441-3459 | cuGucccuccuuGAGcAccTsT | 1175 | GGUGCUcAAGGAGGGAcAGTsT | 1176 | AD-9748 |
| 3480-3498 | ACAUUUAUCUUUUGGGUCUTsT | 1177 | AGACCCAAAAGAUAAAUGUTsT | 1178 | AD-9587 |
| 3480-3498 | AcAuuuAucuuuuGGGucuTsT | 1179 | AGACCcAAAAGAuAAAUGUTsT | 1180 | AD-9713 |
| 3480-3498 | AfcAfuUfuAfuCfuUfuUfgGfgUfcUfTsT | 1181 | p-aGfaCfcCfaAfaAfgAfuAfaAfuGfuTsT | 1182 | AD-14679 |
| 3480-3498 | ACfAUfUfUfAUfCfUfUfUfUfGGGUfCfUfTsT | 1183 | AGACfCfCfAAAAGAUfAAAUfGUfTsT | 1184 | AD-14689 |
| 3480-3498 | AcAuUuAuCuUuUgGgUcUTsT | 1185 | p-aGfaCfcCfaAfaAfgAfuAfaAfuGfuTsT | 1186 | AD-14699 |
| 3480-3498 | AcAuUuAuCuUuUgGgUcUTsT | 1187 | AGACfCfCfAAAAGAUfAAAUfGUfTsT | 1188 | AD-14709 |
| 3480-3498 | AfcAfuUfuAfuCfuUfuUfgGfgUfcUfTsT | 1189 | AGACCcaAAagAUAAAuguTsT | 1190 | AD-14719 |
| 3480-3498 | ACfAUfUfUfAUfCfUfUfUfUfGGGUfCfUfTsT | 1191 | AGACCcaAAagAUAAAuguTsT | 1192 | AD-14729 |
| 3480-3498 | AcAuUuAuCuUuUgGgUcUTsT | 1193 | AGACCcaAAagAUAAAuguTsT | 1194 | AD-14739 |
| 3480-3498 | GfcCfaUfcUfgCfuGfcCfgGfaGfcCfTsT | 1195 | p-gGfcUfcCfgGfcAfgCfaGfaUfgGfcTsT | 1196 | AD-15085 |
| 3480-3498 | GCfCfAUfCfUfGCfUfGCfCfGGAGCfCfTsT | 1197 | GGCfUfCfCfGGCfAGCfAGAUfGGCfTsT | 1198 | AD-15095 |
| 3480-3498 | GcCaUcUgCuGcCgGaGcCTsT | 1199 | p-gGfcUfcCfgGfcAfgCfaGfaUfgGfcTsT | 1200 | AD-15105 |
| 3480-3498 | GcCaUcUgCuGcCgGaGcCTsT | 1201 | GGCfUfCfCfGGCfAGCfAGAUfGGCfTsT | 1202 | AD-15115 |
| 3480-3498 | GfcCfaUfcUfgCfuGfcCfgGfaGfcCfTsT | 1203 | GGCUCauGCagCAGAUggcTsT | 1204 | AD-15125 |
| 3480-3498 | GCfCfAUfCfUfGCfUfGCfCfGGAGCfCfTsT | 1205 | GGCUCauGCagCAGAUggcTsT | 1206 | AD-15135 |
| 3480-3498 | GcCaUcUgCuGcCgGaGcCTsT | 1207 | GGCUCauGCagCAGAUggcTsT | 1208 | AD-15145 |
| 3481-3499 | CAUUUAUCUUUUGGGUCUGTsT | 1209 | CAGACCCAAAAGAUAAAUGTsT | 1210 | AD-9578 |
| 3481-3499 | cAuuuAucuuuuGGGucuGTsT | 1211 | cAGACCcAAAAGAuAAAUGTsT | 1212 | AD-9704 |
| 3485-3503 | UAUCUUUUGGGUCUGUCCUTsT | 1213 | AGGACAGACCCAAAAGAUATsT | 1214 | AD-9558 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 3485-3503 | uAucuuuuGGGucuGuccuTsT | 1215 | AGGAcAGACCcAAAAGAuATsT | 1216 | AD-9684 |
| 3504-3522 | CUCUGUUGCCUUUUUACAGTsT | 1217 | CUGUAAAAAGGCAACAGAGTsT | 1218 | AD-9634 |
| 3504-3522 | cucuGuuGccuuuuuAcAGTsT | 1219 | CUGuAAAAAGGcAAcAGAGTsT | 1220 | AD-9760 |
| 3512-3530 | CCUUUUUACAGCCAACUUUTT | 1221 | AAAGUUGGCUGUAAAAAGGTT | 1222 | AD-15411 |
| 3521-3539 | AGCCAACUUUUCUAGACCUTT | 1223 | AGGUCUAGAAAAGUUGGCUTT | 1224 | AD-15266 |
| 3526-3544 | ACUUUUCUAGACCUGUUUUTT | 1225 | AAAACAGGUCUAGAAAAGUTT | 1226 | AD-15382 |
| 3530-3548 | UUCUAGACCUGUUUUGCUUTsT | 1227 | AAGCAAAACAGGUCUAGAATsT | 1228 | AD-9554 |
| 3530-3548 | uucuAGAccuGuuuuGcuuTsT | 1229 | AAGcAAAAcAGGUCuAGAATsT | 1230 | AD-9680 |
| 3530-3548 | UfuCfuAfgAfcCfuGfuUfuUfgCfuUfTsT | 1231 | p-aAfgCfaAfaAfcAfgGfuCfuAfgAfaTsT | 1232 | AD-14676 |
| 3530-3548 | UfUfCfUfAGACfCfUfGUfUfUfUfGCfUfUfTsT | 1233 | AAGCfAAAACfAGGUfCfUfAGAATsT | 1234 | AD-14686 |
| 3530-3548 | UuCuAgAcCuGuUuUgCuUTsT | 1235 | p-aAfgCfaAfaAfcAfgGfuCfuAfgAfaTsT | 1236 | AD-14696 |
| 3530-3548 | UuCuAgAcCuGuUuUgCuUTsT | 1237 | AAGCfAAAACfAGGUfCfUfAGAATsT | 1238 | AD-14706 |
| 3530-3548 | UfuCfuAfgAfcCfuGfuUfuUffCfuUfTsT | 1239 | AAGcAaaACagGUCUAgaaTsT | 1240 | AD-14716 |
| 3530-3548 | UfUfCfUfAGACfCfUfGUfUfUfUfGCfUfUfTsT | 1241 | AAGcAaaACagGUCUAgaaTsT | 1242 | AD-14726 |
| 3530-3548 | UuCuAgAcCuGuUuUgCuUTsT | 1243 | AAGcAaaACagGUCUAgaaTsT | 1244 | AD-14736 |
| 3530-3548 | CfaUfaGfgCfcUfgGfaGfuUfuAfuUfTsT | 1245 | p-aAfuAfaAfcUfcCfaGfgCfcUfaUfgTsT | 1246 | AD-15082 |
| 3530-3548 | CfAUfAGGCfCfUfGGAGUfUfUfAUfUfTsT | 1247 | AAUfAAACfUfCfCfAGGCfCfUfAUfGTsT | 1248 | AD-15092 |
| 3530-3548 | CaUaGgCcUgGaGuUuAuUTsT | 1249 | p-aAfuAfaAfcUfcCfaGfgCfcUfaUfgTsT | 1250 | AD-15102 |
| 3530-3548 | CaUaGgCcUgGaGuUuAuUTsT | 1251 | AAUfAAACfUfCfCfAGGCfCfUfAUfGTsT | 1252 | AD-15112 |
| 3530-3548 | CfaUfaGfgCfcUfgGfaGfuUfuAfuUfTsT | 1253 | AAUAAacUCcaGGCCUaugTsT | 1254 | AD-15122 |
| 3530-3548 | CfAUfAGGCfCfUfGGAGUfUfUfAUfUfTsT | 1255 | AAUAAacUCcaGGCCUaugTsT | 1256 | AD-15132 |
| 3530-3548 | CaUaGgCcUgGaGuUuAuUTsT | 1257 | AAUAAacUCcaGGCCUaugTsT | 1258 | AD-15142 |
| 3531-3549 | UCUAGACCUGUUUUGCUUUTsT | 1259 | AAAGCAAAACAGGUCUAGATsT | 1260 | AD-9553 |
| 3531-3549 | ucuAGAccuGuuuuGcuuuTsT | 1261 | AAAGcAAAAcAGGUCuAGATsT | 1262 | AD-9679 |

TABLE 1a-continued dsRNA sequences targeted to PCSK9

| position in human access. # NM_174936 | Sense strand sequence (5'-3')[1] | SEQ ID NO: | Antisense-strand sequence (5'-3')[1] | SEQ ID NO: | Duplex name |
|---|---|---|---|---|---|
| 3531-3549 | UfcUfaGfaCfcUfgUfuUfuGfcUfuUfTsT | 1263 | p-aAfaGfcAfaAfaCfaGfgUfcUfaGfaTsT | 1264 | AD-14675 |
| 3531-3549 | UfCfUfAGACfCfUfGUfUfUfUfGCfUfUfUfTsT | 1265 | AAAGCfAAAACfAGGUfCfUfAGATsT | 1266 | AD-14685 |
| 3531-3549 | UcUaGaCcUgUuUuGcUuUTsT | 1267 | p-aAfaGfcAfaAfaCfaGfgUfcUfaGfaTsT | 1268 | AD-14695 |
| 3531-3549 | UcUaGaCcUgUuUuGcUuUTsT | 1269 | AAAGCfAAAACfAGGUfCfUfAGATsT | 1270 | AD-14705 |
| 3531-3549 | UfcUfaGfaCfcUfgUfuUfuGfcUfuUfTsT | 1271 | AAAGCaaAAcaGGUCUagaTsT | 1272 | AD-14715 |
| 3531-3549 | UfCfUfAGACfCfUfGUfUfUfUfGCfUfUfUfTsT | 1273 | AAAGCaaAAcaGGUCUagaTsT | 1274 | AD-14725 |
| 3531-3549 | UcUaGaCcUgUuUuGcUuUTsT | 1275 | AAAGCaaAAcaGGUCUagaTsT | 1276 | AD-14735 |
| 3531-3549 | UfcAfuAfgGfcCfuGfgAfgUfuUfaUfTsT | 1277 | p-aUfaAfaCfuCfcAfgGfcCfuAfuGfaTsT | 1278 | AD-15081 |
| 3531-3549 | UfCfAUfAGGCfCfUfGGAGUfUfUfAUfTsT | 1279 | AUfAAACfUfCfCfAGGCfCfUfAUfGATsT | 1280 | AD-15091 |
| 3531-3549 | UcAuAgGcCuGgAgUuUaUTsT | 1281 | p-aUfaAfaCfuCfcAfgGfcCfuAfuGfaTsT | 1282 | AD-15101 |
| 3531-3549 | UcAuAgGcCuGgAgUuUaUTsT | 1283 | AUfAAACfUfCfCfAGGCfCfUfAUfGATsT | 1284 | AD-15111 |
| 3531-3549 | UfcAfuAfgGfcCfuGfgAfgUfuUfaUfTsT | 1285 | AUAAAcuCCagGCCUAugaTsT | 1286 | AD-15121 |
| 3531-3549 | UfCfAUfAGGCfCfUfGGAGUfUfUfAUfTsT | 1287 | AUAAAcuCCagGCCUAugaTsT | 1288 | AD-15131 |
| 3531-3549 | UcAuAgGcCuGgAgUuUaUTsT | 1289 | AUAAAcuCCagGCCUAugaTsT | 1290 | AD-15141 |
| 3557-3575 | UGAAGAUAUUUAUUCUGGGTsT | 1291 | CCCAGAAUAAAUAUCUUCATsT | 1292 | AD-9626 |
| 3557-3575 | uGAAGAuAuuuAuucuGGGTsT | 1293 | CCcAGAAuAAAuAUCUUcATsT | 1294 | AD-9752 |
| 3570-3588 | UCUGGGUUUUGUAGCAUUUTsT | 1295 | AAAUGCUACAAAACCCAGATsT | 1296 | AD-9629 |
| 3570-3588 | ucuGGGuuuuGuAGcAuuuTsT | 1297 | AAAUGCuAcAAAACCcAGATsT | 1298 | AD-9755 |
| 3613-3631 | AUAAAAACAAACAAACGUUTT | 1299 | AACGUUUGUUUGUUUUUAUTT | 1300 | AD-15412 |
| 3617-3635 | AAACAAACAAACGUUGUCCTT | 1301 | GGACAACGUUUGUUUGUUUTT | 1302 | AD-15211 |
| 3618-3636 | AACAAACAAACGUUGUCCUTT | 1303 | AGGACAACGUUUGUUUGUUTT | 1304 | AD-15300 |

U, C, A, G: corresponding ribonucleotide;
T: deoxythymidine;
u, c, a, g: corresponding 2'-O-methyl ribonucleotide;
Uf, Cf, Af, Gf: corresponding 2'-deoxy-2'-fluoro ribonucleotide; where nucleotides are written in sequence, they are connected by 3'-5' phosphodiester groups;
nucleotides with interjected "s" are connected by 3'-O-5'-O phosphorothiodiester groups; unless denoted by prefix "p-", oligonucleotides are devoid of a 5'-phosphate group on the 5'-most nucleotide;
all oligonucleotides bear 3'-OH on the 3'-most nucleotide

TABLE 1b

Screening of siRNAs targeted to PCSK9

| Duplex name | 100 nM/ HepG2 | 30 nM/ HepG2 | 3 nM/ HepG2 | 30 nM/ HeLa | IC50 in HepG2 [nM] | IC50 in Cynomolgous monkey Hepatocyte [nM]s |
|---|---|---|---|---|---|---|
| AD-15220 | | | | 35 | | |
| AD-15275 | | | | 56 | | |
| AD-15301 | | | | 70 | | |
| AD-15276 | | | | 42 | | |
| AD-15302 | | | | 32 | | |
| AD-15303 | | | | 37 | | |
| AD-15221 | | | | 30 | | |
| AD-15413 | | | | 61 | | |
| AD-15304 | | | | 70 | | |
| AD-15305 | | | | 36 | | |
| AD-15306 | | | | 20 | | |
| AD-15307 | | | | 38 | | |
| AD-15277 | | | | 50 | | |
| AD-9526 | 74 | 89 | | | | |
| AD-9652 | | 97 | | | | |
| AD-9519 | | 78 | | | | |
| AD-9645 | | 66 | | | | |
| AD-9523 | | 55 | | | | |
| AD-9649 | | 60 | | | | |
| AD-9569 | | 112 | | | | |
| AD-9695 | | 102 | | | | |
| AD-15222 | | | | 75 | | |
| AD-15278 | | | | 78 | | |
| AD-15178 | | | | 83 | | |
| AD-15308 | | | | 84 | | |
| AD-15223 | | | | 67 | | |
| AD-15309 | | | | 34 | | |
| AD-15279 | | | | 44 | | |
| AD-15194 | | | | 63 | | |
| AD-15310 | | | | 42 | | |
| AD-15311 | | | | 30 | | |
| AD-15392 | | | | 18 | | |
| AD-15312 | | | | 21 | | |
| AD-15313 | | | | 19 | | |
| AD-15280 | | | | 81 | | |
| AD-15267 | | | | 82 | | |
| AD-15314 | | | | 32 | | |
| AD-15315 | | | | 74 | | |
| AD-9624 | | 94 | | | | |
| AD-9750 | | 96 | | | | |
| AD-9623 | 43 | 66 | | | | |
| AD-9749 | | 105 | | | | |
| AD-15384 | | | | 48 | | |
| AD-9607 | | 32 | 28 | | 0.20 | |
| AD-9733 | | 78 | 73 | | | |
| AD-9524 | | 23 | 28 | | 0.07 | |
| AD-9650 | | 91 | 90 | | | |
| AD-9520 | | 23 | 32 | | | |
| AD-9520 | | 23 | | | | |
| AD-9646 | | 97 | 108 | | | |
| AD-9608 | | 37 | | | | |
| AD-9734 | | 91 | | | | |
| AD-9546 | | 32 | | | | |
| AD-9672 | | 57 | | | | |
| AD-15385 | | | | 54 | | |
| AD-15393 | | | | 31 | | |
| AD-15316 | | | | 37 | | |
| AD-15317 | | | | 37 | | |
| AD-15318 | | | | 63 | | |
| AD-15195 | | | | 45 | | |
| AD-15224 | | | | 57 | | |
| AD-15188 | | | | 42 | | |
| AD-15225 | | | | 51 | | |
| AD-15281 | | | | 89 | | |
| AD-15282 | | | | 75 | | |
| AD-15319 | | | | 61 | | |
| AD-15226 | | | | 56 | | |
| AD-15271 | | | | 25 | | |
| AD-15283 | | | | 25 | | |
| AD-15284 | | | | 64 | | |
| AD-15189 | | | | 17 | | |
| AD-15227 | | | | 62 | | |
| AD-9547 | | 31 | 29 | | 0.20 | |
| AD-9673 | | 56 | 57 | | | |
| AD-9548 | | 54 | 60 | | | |
| AD-9674 | | 36 | 57 | | | |
| AD-9529 | | 60 | | | | |
| AD-9655 | | 140 | | | | |
| AD-9605 | | 27 | 31 | | 0.27 | |
| AD-9731 | | 31 | 31 | | 0.32 | |
| AD-9596 | | 37 | | | | |
| AD-9722 | | 76 | | | | |
| AD-9583 | | 42 | | | | |
| AD-9709 | | 104 | | | | |
| AD-9579 | | 113 | | | | |
| AD-9705 | | 81 | | | | |
| AD-15394 | | | | 32 | | |
| AD-15196 | | | | 72 | | |
| AD-15197 | | | | 85 | | |
| AD-15198 | | | | 71 | | |
| AD-9609 | 66 | 71 | | | | |
| AD-9735 | | 115 | | | | |
| AD-9537 | | 145 | | | | |
| AD-9663 | | 102 | | | | |
| AD-9528 | | 113 | | | | |
| AD-9654 | | 107 | | | | |
| AD-9515 | | 49 | | | | |
| AD-9641 | | 92 | | | | |
| AD-9514 | | 57 | | | | |
| AD-9640 | | 89 | | | | |
| AD-9530 | | 75 | | | | |
| AD-9656 | | 77 | | | | |
| AD-9538 | 79 | 80 | | | | |
| AD-9664 | | 53 | | | | |
| AD-9598 | 69 | 83 | | | | |
| AD-9724 | | 127 | | | | |
| AD-9625 | 58 | 88 | | | | |
| AD-9751 | | 60 | | | | |
| AD-9556 | | 46 | | | | |
| AD-9682 | | 38 | | | | |
| AD-9539 | 56 | 63 | | | | |
| AD-9665 | | 83 | | | | |
| AD-9517 | | 36 | | | | |
| AD-9643 | | 40 | | | | |
| AD-9610 | | 36 | 34 | | 0.04 | |
| AD-9736 | | 22 | 29 | | 0.04 | 0.5 |
| AD-14681 | | | | 33 | | |
| AD-14691 | | | | 27 | | |
| AD-14701 | | | | 32 | | |
| AD-14711 | | | | 33 | | |
| AD-14721 | | | | 22 | | |
| AD-14731 | | | | 21 | | |
| AD-14741 | | | | 22 | | |
| AD-15087 | | | | 37 | | |
| AD-15097 | | | | 51 | | |
| AD-15107 | | | | 26 | | |
| AD-15117 | | | | 28 | | |
| AD-15127 | | | | 33 | | |
| AD-15137 | | | | 54 | | |
| AD-15147 | | | | 52 | | |
| AD-9516 | | 94 | | | | |
| AD-9642 | | 105 | | | | |
| AD-9562 | | 46 | 51 | | | |
| AD-9688 | | 26 | 34 | | 4.20 | |
| AD-14677 | | | | 38 | | |
| AD-14687 | | | | 52 | | |
| AD-14697 | | | | 35 | | |
| AD-14707 | | | | 58 | | |
| AD-14717 | | | | 42 | | |
| AD-14727 | | | | 50 | | |

TABLE 1b-continued

Screening of siRNAs targeted to PCSK9

| Duplex name | 100 nM/ HepG2 | 30 nM/ HepG2 | 3 nM/ HepG2 | 30 nM/ HeLa | IC50 in HepG2 [nM] | IC50 in Cynomolgous monkey Hepatocyte [nM]s |
|---|---|---|---|---|---|---|
| AD-14737 | | | | 32 | | |
| AD-15083 | | | | 16 | | |
| AD-15093 | | | | 24 | | |
| AD-15103 | | | | 11 | | |
| AD-15113 | | | | 34 | | |
| AD-15123 | | | | 19 | | |
| AD-15133 | | | | 15 | | |
| AD-15143 | | | | 16 | | |
| AD-9521 | | 50 | | | | |
| AD-9647 | | 62 | | | | |
| AD-9611 | | 48 | | | | |
| AD-9737 | | 68 | | | | |
| AD-9592 | 46 | 55 | | | | |
| AD-9718 | | 78 | | | | |
| AD-9561 | | 64 | | | | |
| AD-9687 | | 84 | | | | |
| AD-9636 | | 42 | 41 | | 2.10 | |
| AD-9762 | | 9 | 28 | | 0.40 | 0.5 |
| AD-9540 | | 45 | | | | |
| AD-9666 | | 81 | | | | |
| AD-9535 | 48 | 73 | | | | |
| AD-9661 | | 83 | | | | |
| AD-9559 | | 35 | | | | |
| AD-9685 | | 77 | | | | |
| AD-9533 | | 100 | | | | |
| AD-9659 | | 88 | | | | |
| AD-9612 | | 122 | | | | |
| AD-9738 | | 83 | | | | |
| AD-9557 | 75 | 96 | | | | |
| AD-9683 | | 48 | | | | |
| AD-9531 | | 31 | 32 | | 0.53 | |
| AD-9657 | | 23 | 29 | | 0.66 | 0.5 |
| AD-14673 | | | | 81 | | |
| AD-14683 | | | | 56 | | |
| AD-14693 | | | | 56 | | |
| AD-14703 | | | | 68 | | |
| AD-14713 | | | | 55 | | |
| AD-14723 | | | | 24 | | |
| AD-14733 | | | | 34 | | |
| AD-15079 | | | | 85 | | |
| AD-15089 | | | | 54 | | |
| AD-15099 | | | | 70 | | |
| AD-15109 | | | | 67 | | |
| AD-15119 | | | | 67 | | |
| AD-15129 | | | | 57 | | |
| AD-15139 | | | | 69 | | |
| AD-9542 | | 160 | | | | |
| AD-9668 | | 92 | | | | |
| AD-9739 | | 109 | | | | |
| AD-9637 | 56 | 83 | | | | |
| AD-9763 | | 79 | | | | |
| AD-9630 | | 82 | | | | |
| AD-9756 | | 63 | | | | |
| AD-9593 | | 55 | | | | |
| AD-9719 | | 115 | | | | |
| AD-9601 | | 111 | | | | |
| AD-9727 | | 118 | | | | |
| AD-9573 | | 36 | 42 | | 1.60 | |
| AD-9699 | | 32 | 36 | | 2.50 | |
| AD-15228 | | | | 26 | | |
| AD-15395 | | | | 53 | | |
| AD-9602 | | 126 | | | | |
| AD-9728 | | 94 | | | | |
| AD-15386 | | | | 45 | | |
| AD-9580 | | 112 | | | | |
| AD-9706 | | 86 | | | | |
| AD-9581 | | 35 | | | | |
| AD-9707 | | 81 | | | | |
| AD-9543 | | 51 | | | | |
| AD-9669 | | 97 | | | | |
| AD-9574 | | 74 | | | | |
| AD-9700 | | | | | | |
| AD-15320 | | | | 26 | | |
| AD-15321 | | | | 34 | | |
| AD-15199 | | | | 64 | | |
| AD-15167 | | | | 86 | | |
| AD-15164 | | | | 41 | | |
| AD-15166 | | | | 43 | | |
| AD-15322 | | | | 64 | | |
| AD-15200 | | | | 46 | | |
| AD-15213 | | | | 27 | | |
| AD-15229 | | | | 44 | | |
| AD-15215 | | | | 49 | | |
| AD-15214 | | | | 101 | | |
| AD-9315 | | 15 | 32 | | 0.98 | |
| AD-9326 | | 35 | 51 | | | |
| AD-9318 | | 14 | 37 | | 0.40 | |
| AD-9323 | | 14 | 33 | | | |
| AD-9314 | | | 11 | 22 | 0.04 | |
| AD-10792 | | | | | 0.10 | 0.10 |
| AD-10796 | | | | | 0.1 | 0.1 |
| AD-9638 | | 101 | | | | |
| AD-9764 | | 112 | | | | |
| AD-9525 | | 53 | | | | |
| AD-9651 | | 58 | | | | |
| AD-9560 | | 97 | | | | |
| AD-9686 | | 111 | | | | |
| AD-9536 | | 157 | | | | |
| AD-9662 | | 81 | | | | |
| AD-9584 | 52 | 68 | | | | |
| AD-9710 | | 111 | | | | |
| AD-15323 | | | | 62 | | |
| AD-9551 | | 91 | | | | |
| AD-9677 | | 62 | | | | |
| AD-15230 | | | | 52 | | |
| AD-15231 | | | | 25 | | |
| AD-15285 | | | | 36 | | |
| AD-15396 | | | | 27 | | |
| AD-15397 | | | | 56 | | |
| AD-9600 | | 112 | | | | |
| AD-9726 | | 95 | | | | |
| AD-9606 | | 107 | | | | |
| AD-9732 | | 105 | | | | |
| AD-9633 | 56 | 75 | | | | |
| AD-9759 | | 111 | | | | |
| AD-9588 | | 66 | | | | |
| AD-9714 | | 106 | | | | |
| AD-9589 | 67 | 85 | | | | |
| AD-9715 | | 113 | | | | |
| AD-9575 | | 120 | | | | |
| AD-9701 | | 100 | | | | |
| AD-9563 | | 103 | | | | |
| AD-9689 | | 81 | | | | |
| AD-9594 | 80 | 95 | | | | |
| AD-9720 | | 92 | | | | |
| AD-9585 | | 83 | | | | |
| AD-9711 | | 122 | | | | |
| AD-9614 | | 100 | | | | |
| AD-9740 | | 198 | | | | |
| AD-9615 | | 116 | | | | |
| AD-9741 | | 130 | | | | |
| AD-9534 | | | 32 | 30 | | |
| AD-9534 | | | 32 | | | |
| AD-9660 | | 89 | 79 | | | |
| AD-15324 | | | | 46 | | |
| AD-15232 | | | | 19 | | |
| AD-15233 | | | | 25 | | |
| AD-15234 | | | | 59 | | |
| AD-15286 | | | | 109 | | |
| AD-9590 | | 122 | | | | |

TABLE 1b-continued

Screening of siRNAs targeted to PCSK9

| Duplex name | 100 nM/ HepG2 | 30 nM/ HepG2 | 3 nM/ HepG2 | 30 nM/ HeLa | IC50 in HepG2 [nM] | IC50 in Cynomolgous monkey Hepatocyte [nM]s |
|---|---|---|---|---|---|---|
| AD-9716 | | 114 | | | | |
| AD-9632 | | 34 | | | | |
| AD-9758 | | 96 | | | | |
| AD-9567 | | 41 | | | | |
| AD-9693 | | 50 | | | | |
| AD-9586 | 81 | 104 | | | | |
| AD-9712 | | 107 | | | | |
| AD-9564 | | 120 | | | | |
| AD-9690 | | 92 | | | | |
| AD-9616 | 74 | 84 | | | | |
| AD-9742 | | 127 | | | | |
| AD-15398 | | | | 24 | | |
| AD-9617 | | 111 | | | | |
| AD-9743 | | 104 | | | | |
| AD-9635 | 73 | 90 | | | | |
| AD-9761 | | 15 | 33 | | 0.5 | |
| AD-9568 | | 76 | | | | |
| AD-9694 | | 52 | | | | |
| AD-9576 | | 47 | | | | |
| AD-9702 | | 79 | | | | |
| AD-9627 | | 69 | | | | |
| AD-9753 | | 127 | | | | |
| AD-9628 | | 141 | | | | |
| AD-9754 | | 89 | | | | |
| AD-9631 | | 80 | | | | |
| AD-9757 | | 78 | | | | |
| AD-9595 | | 31 | 32 | | | |
| AD-9721 | | 87 | 70 | | | |
| AD-9544 | | 68 | | | | |
| AD-9670 | | 67 | | | | |
| AD-15235 | | | | 25 | | |
| AD-15236 | | | | 73 | | |
| AD-15168 | | | | 100 | | |
| AD-15174 | | | | 92 | | |
| AD-15325 | | | | 81 | | |
| AD-15326 | | | | 65 | | |
| AD-9570 | 35 | 42 | | | | |
| AD-9696 | | 77 | | | | |
| AD-9566 | | 38 | | | | |
| AD-9692 | | 78 | | | | |
| AD-9532 | | 100 | | | | |
| AD-9658 | | 102 | | | | |
| AD-9549 | | 50 | | | | |
| AD-9675 | | 78 | | | | |
| AD-9541 | | 43 | | | | |
| AD-9667 | | 73 | | | | |
| AD-9550 | | 36 | | | | |
| AD-9676 | | 100 | | | | |
| AD-9571 | | 27 | 32 | | | |
| AD-9697 | | 74 | 89 | | | |
| AD-9572 | 47 | 53 | | | | |
| AD-9698 | | 73 | | | | |
| AD-15327 | | | | 82 | | |
| AD-9639 | | 30 | 35 | | | |
| AD-9765 | | 82 | 74 | | | |
| AD-9518 | | 31 | 35 | | 0.60 | |
| AD-9518 | | 31 | | | | |
| AD-9644 | | 35 | 37 | | 2.60 | 0.5 |
| AD-14672 | | | | 26 | | |
| AD-14682 | | | | 27 | | |
| AD-14692 | | | | 22 | | |
| AD-14702 | | | | 19 | | |
| AD-14712 | | | | 25 | | |
| AD-14722 | | | | 18 | | |
| AD-14732 | | | | 32 | | |
| AD-15078 | | | | 86 | | |
| AD-15088 | | | | 97 | | |
| AD-15098 | | | | 74 | | |
| AD-15108 | | | | 67 | | |
| AD-15118 | | | | 76 | | |
| AD-15128 | | | | 86 | | |
| AD-15138 | | | | 74 | | |
| AD-15237 | | | | 30 | | |
| AD-15287 | | | | 30 | | |
| AD-15238 | | | | 36 | | |
| AD-15328 | | | | 35 | | |
| AD-15399 | | | | 47 | | |
| AD-9582 | | 37 | | | | |
| AD-9708 | | 81 | | | | |
| AD-9545 | | 31 | 43 | | | |
| AD-9671 | | 15 | 33 | | 2.50 | |
| AD-14674 | | | | 16 | | |
| AD-14684 | | | | 26 | | |
| AD-14694 | | | | 18 | | |
| AD-14704 | | | | 27 | | |
| AD-14714 | | | | 20 | | |
| AD-14724 | | | | 18 | | |
| AD-14734 | | | | 18 | | |
| AD-15080 | | | | 29 | | |
| AD-15090 | | | | 23 | | |
| AD-15100 | | | | 26 | | |
| AD-15110 | | | | 23 | | |
| AD-15120 | | | | 20 | | |
| AD-15130 | | | | 20 | | |
| AD-15140 | | | | 19 | | |
| AD-9522 | | 59 | | | | |
| AD-9648 | | 78 | | | | |
| AD-9552 | | 80 | | | | |
| AD-9678 | | 76 | | | | |
| AD-9618 | | 90 | | | | |
| AD-9744 | | 91 | | | | |
| AD-15239 | | | | 38 | | |
| AD-15212 | | | | 19 | | |
| AD-15240 | | | | 43 | | |
| AD-15177 | | | | 59 | | |
| AD-15179 | | | | 13 | | |
| AD-15180 | | | | 15 | | |
| AD-15241 | | | | 14 | | |
| AD-15268 | | | | 42 | | |
| AD-15242 | | | | 21 | | |
| AD-15216 | | | | 28 | | |
| AD-15176 | | | | 35 | | |
| AD-15181 | | | | 35 | | |
| AD-15243 | | | | 22 | | |
| AD-15182 | | | | 42 | | |
| AD-15244 | | | | 31 | | |
| AD-15387 | | | | 23 | | |
| AD-15245 | | | | 18 | | |
| AD-9555 | | 34 | | | | |
| AD-9681 | | 55 | | | | |
| AD-9619 | 42 | 61 | | | | |
| AD-9745 | | 56 | | | | |
| AD-9620 | 44 | 77 | | | | |
| AD-9746 | | 89 | | | | |
| AD-15288 | | | | 19 | | |
| AD-15246 | | | | 16 | | |
| AD-15289 | | | | 37 | | |
| AD-9324 | | 59 | 67 | | | |
| AD-15329 | | | | 103 | | |
| AD-15330 | | | | 62 | | |
| AD-15169 | | | | 22 | | |
| AD-15201 | | | | 6 | | |
| AD-15331 | | | | 14 | | |
| AD-15190 | | | | 47 | | |
| AD-15247 | | | | 61 | | |
| AD-15248 | | | | 22 | | |
| AD-15175 | | | | 45 | | |
| AD-15249 | | | | 51 | | |
| AD-15250 | | | | 96 | | |
| AD-15400 | | | | 12 | | |

TABLE 1b-continued

Screening of siRNAs targeted to PCSK9

| Duplex name | 100 nM/ HepG2 | 30 nM/ HepG2 | 3 nM/ HepG2 | 30 nM/ HeLa | IC50 in HepG2 [nM] | IC50 in Cynomolgous monkey Hepatocyte [nM]s |
|---|---|---|---|---|---|---|
| AD-15332 | | | | 22 | | |
| AD-15388 | | | | 30 | | |
| AD-15333 | | | | 20 | | |
| AD-15334 | | | | 96 | | |
| AD-15335 | | | | 75 | | |
| AD-15183 | | | | 16 | | |
| AD-15202 | | | | 41 | | |
| AD-15203 | | | | 39 | | |
| AD-15272 | | | | 49 | | |
| AD-15217 | | | | 16 | | |
| AD-15290 | | | | 15 | | |
| AD-15218 | | | | 13 | | |
| AD-15389 | | | | 13 | | |
| AD-15336 | | | | 40 | | |
| AD-15337 | | | | 19 | | |
| AD-15191 | | | | 33 | | |
| AD-15390 | | | | 25 | | |
| AD-15338 | | | | 9 | | |
| AD-15204 | | | | 33 | | |
| AD-15251 | | | | 76 | | |
| AD-15205 | | | | 14 | | |
| AD-15171 | | | | 16 | | |
| AD-15252 | | | | 58 | | |
| AD-15339 | | | | 20 | | |
| AD-15253 | | | | 15 | | |
| AD-15340 | | | | 18 | | |
| AD-15291 | | | | 17 | | |
| AD-15341 | | | | 11 | | |
| AD-15401 | | | | 13 | | |
| AD-15342 | | | | 30 | | |
| AD-15343 | | | | 21 | | |
| AD-15292 | | | | 16 | | |
| AD-15344 | | | | 20 | | |
| AD-15254 | | | | 18 | | |
| AD-15345 | | | | 18 | | |
| AD-15206 | | | | 15 | | |
| AD-15346 | | | | 16 | | |
| AD-15347 | | | | 62 | | |
| AD-9577 | | 33 | 31 | | | |
| AD-9703 | | 17 | 26 | | | 1 |
| AD-14678 | | | | 22 | | |
| AD-14688 | | | | 23 | | |
| AD-14698 | | | | 23 | | |
| AD-14708 | | | | 14 | | |
| AD-14718 | | | | 31 | | |
| AD-14728 | | | | 25 | | |
| AD-14738 | | | | 31 | | |
| AD-15084 | | | | 19 | | |
| AD-15094 | | | | 11 | | |
| AD-15104 | | | | 16 | | |
| AD-15114 | | | | 15 | | |
| AD-15124 | | | | 11 | | |
| AD-15134 | | | | 12 | | |
| AD-15144 | | | | 9 | | |
| AD-15391 | | | | 7 | | |
| AD-15348 | | | | 13 | | |
| AD-15349 | | | | 8 | | |
| AD-15170 | | | | 40 | | |
| AD-15350 | | | | 14 | | |
| AD-15402 | | | | 27 | | |
| AD-15293 | | | | 27 | | |
| AD-15351 | | | | 14 | | |
| AD-15403 | | | | 11 | | |
| AD-15404 | | | | 38 | | |
| AD-15207 | | | | 15 | | |
| AD-15352 | | | | 23 | | |
| AD-15255 | | | | 31 | | |
| AD-9603 | | 123 | | | | |
| AD-9729 | | 56 | | | | |
| AD-9599 | | 139 | | | | |
| AD-9725 | | 38 | | | | |
| AD-9621 | | 77 | | | | |
| AD-9747 | | 63 | | | | |
| AD-15405 | | | | 32 | | |
| AD-15353 | | | | 39 | | |
| AD-15354 | | | | 49 | | |
| AD-15406 | | | | 35 | | |
| AD-15407 | | | | 39 | | |
| AD-15355 | | | | 18 | | |
| AD-15356 | | | | 50 | | |
| AD-15357 | | | | 54 | | |
| AD-15269 | | | | 23 | | |
| AD-9565 | | 74 | | | | |
| AD-9691 | | 49 | | | | |
| AD-15358 | | | | 12 | | |
| AD-15359 | | | | 24 | | |
| AD-15360 | | | | 13 | | |
| AD-15219 | | | | 19 | | |
| AD-15361 | | | | 24 | | |
| AD-15273 | | | | 36 | | |
| AD-15362 | | | | 31 | | |
| AD-15192 | | | | 20 | | |
| AD-15256 | | | | 19 | | |
| AD-15363 | | | | 33 | | |
| AD-15364 | | | | 24 | | |
| AD-9604 | 35 | 49 | | | | |
| AD-9730 | | 85 | | | | |
| AD-9527 | | 45 | | | | |
| AD-9653 | | 86 | | | | |
| AD-15365 | | | | 62 | | |
| AD-15294 | | | | 30 | | |
| AD-15173 | | | | 12 | | |
| AD-15366 | | | | 21 | | |
| AD-15367 | | | | 11 | | |
| AD-15257 | | | | 18 | | |
| AD-15184 | | | | 50 | | |
| AD-15185 | | | | 12 | | |
| AD-15258 | | | | 73 | | |
| AD-15186 | | | | 36 | | |
| AD-15274 | | | | 19 | | |
| AD-15368 | | | | 7 | | |
| AD-15369 | | | | 17 | | |
| AD-15370 | | | | 19 | | |
| AD-15259 | | | | 38 | | |
| AD-15408 | | | | 52 | | |
| AD-9597 | | 23 | 21 | | 0.04 | |
| AD-9723 | | 12 | 26 | | | 0.5 |
| AD-14680 | | | | 15 | | |
| AD-14690 | | | | 18 | | |
| AD-14700 | | | | 15 | | |
| AD-14710 | | | | 15 | | |
| AD-14720 | | | | 18 | | |
| AD-14730 | | | | 18 | | |
| AD-14740 | | | | 17 | | |
| AD-15086 | | | | 85 | | |
| AD-15096 | | | | 70 | | |
| AD-15106 | | | | 71 | | |
| AD-15116 | | | | 73 | | |
| AD-15126 | | | | 71 | | |
| AD-15136 | | | | 56 | | |
| AD-15146 | | | | 72 | | |
| AD-15260 | | | | 79 | | |
| AD-15371 | | | | 24 | | |
| AD-15372 | | | | 52 | | |
| AD-15172 | | | | 27 | | |
| AD-15295 | | | | 22 | | |
| AD-15373 | | | | 11 | | |
| AD-15163 | | | | 18 | | |
| AD-15165 | | | | 13 | | |
| AD-15374 | | | | 23 | | |

TABLE 1b-continued

Screening of siRNAs targeted to PCSK9

| Duplex name | 100 nM/ HepG2 | 30 nM/ HepG2 | 3 nM/ HepG2 | 30 nM/ HeLa | IC50 in HepG2 [nM] | IC50 in Cynomolgous monkey Hepatocyte [nM]s |
|---|---|---|---|---|---|---|
| AD-15296 | | | | 13 | | |
| AD-15261 | | | | 20 | | |
| AD-15375 | | | | 90 | | |
| AD-15262 | | | | 72 | | |
| AD-15376 | | | | 14 | | |
| AD-15377 | | | | 19 | | |
| AD-15409 | | | | 17 | | |
| AD-15378 | | | | 18 | | |
| AD-15410 | | | | 8 | | |
| AD-15379 | | | | 11 | | |
| AD-15187 | | | | 36 | | |
| AD-15263 | | | | 18 | | |
| AD-15264 | | | | 75 | | |
| AD-15297 | | | | 21 | | |
| AD-15208 | | | | 6 | | |
| AD-15209 | | | | 28 | | |
| AD-15193 | | | | 131 | | |
| AD-15380 | | | | 88 | | |
| AD-15298 | | | | 43 | | |
| AD-15299 | | | | 99 | | |
| AD-15265 | | | | 95 | | |
| AD-15381 | | | | 18 | | |
| AD-15210 | | | | 40 | | |
| AD-15270 | | | | 83 | | |
| AD-9591 | 75 | 95 | | | | |
| AD-9717 | | 105 | | | | |
| AD-9622 | | 94 | | | | |
| AD-9748 | | 103 | | | | |
| AD-9587 | | 63 | 49 | | | |
| AD-9713 | | 22 | 25 | | 0.5 | |
| AD-14679 | | | | 19 | | |
| AD-14689 | | | | 24 | | |
| AD-14699 | | | | 19 | | |
| AD-14709 | | | | 21 | | |
| AD-14719 | | | | 24 | | |
| AD-14729 | | | | 23 | | |
| AD-14739 | | | | 24 | | |
| AD-15085 | | | | 74 | | |
| AD-15095 | | | | 60 | | |
| AD-15105 | | | | 33 | | |
| AD-15115 | | | | 30 | | |
| AD-15125 | | | | 54 | | |
| AD-15135 | | | | 51 | | |
| AD-15145 | | | | 49 | | |
| AD-9578 | 49 | 61 | | | | |
| AD-9704 | | 111 | | | | |
| AD-9558 | | 66 | | | | |
| AD-9684 | | 63 | | | | |
| AD-9634 | | 29 | 30 | | | |
| AD-9760 | | 14 | 27 | | | |
| AD-15411 | | | | 5 | | |
| AD-15266 | | | | 23 | | |
| AD-15382 | | | | 12 | | |
| AD-9554 | | 23 | 24 | | | |
| AD-9680 | | 12 | 22 | | 0.1 | 0.1 |
| AD-14676 | | | | 12 | | .1 |
| AD-14686 | | | | 13 | | |
| AD-14696 | | | | 12 | | .1 |
| AD-14706 | | | | 18 | | .1 |
| AD-14716 | | | | 17 | | .1 |
| AD-14726 | | | | 16 | | .1 |
| AD-14736 | | | | 9 | | .1 |
| AD-15082 | | | | 27 | | |
| AD-15092 | | | | 28 | | |
| AD-15102 | | | | 19 | | |
| AD-15112 | | | | 17 | | |
| AD-15122 | | | | 56 | | |
| AD-15132 | | | | 39 | | |
| AD-15142 | | | | 46 | | |
| AD-9553 | | 27 | 22 | | 0.02 | |
| AD-9679 | | 17 | 21 | | | 0.1 |
| AD-14675 | | | | 11 | | |
| AD-14685 | | | | 19 | | |
| AD-14695 | | | | 12 | | |
| AD-14705 | | | | 16 | | |
| AD-14715 | | | | 19 | | |
| AD-14725 | | | | 19 | | |
| AD-14735 | | | | 19 | | |
| AD-15081 | | | | 30 | | |
| AD-15091 | | | | 16 | | |
| AD-15101 | | | | 16 | | |
| AD-15111 | | | | 11 | | |
| AD-15121 | | | | 19 | | |
| AD-15131 | | | | 17 | | |
| AD-15141 | | | | 18 | | |
| AD-9626 | | 97 | 68 | | | |
| AD-9752 | | 28 | 33 | | | |
| AD-9629 | | 23 | 24 | | | |
| AD-9755 | | 28 | 29 | | | 0.5 |
| AD-15412 | | | | 21 | | |
| AD-15211 | | | | 73 | | |
| AD-15300 | | | | 41 | | |

TABLE 2a

Sequences of modified dsRNA targeted to PCSK9

| Duplex number | Sense strand sequence (5'-3')[1] | SEQ ID NO: | Antisense-strand sequence (5'-3')[1] | SEQ ID NO: |
|---|---|---|---|---|
| AD-10792 | GccuGGAGuuuAuucGGAATsT | 1305 | UUCCGAAuAAACUCcAGGCTsT | 1306 |
| AD-10793 | GccuGGAGuuuAuucGGAATsT | 1307 | uUcCGAAuAAACUccAGGCTsT | 1308 |
| AD-10796 | GccuGGAGuuuAuucGGAATsT | 1309 | UUCCGAAUAAACUCCAGGCTsT | 1310 |
| AD-12038 | GccuGGAGuuuAuucGGAATsT | 1311 | uCCGAAUAAACUCCAGGCTsT | 1312 |
| AD-12039 | GccuGGAGuuuAuucGGAATsT | 1313 | UuCCGAAUAAACUCCAGGCTsT | 1314 |
| AD-12040 | GccuGGAGuuuAuucGGAATsT | 1315 | UUcCGAAUAAACUCCAGGCTsT | 1316 |

TABLE 2a-continued

Sequences of modified dsRNA targeted to PCSK9

| Duplex number | Sense strand sequence (5'-3')[1] | SEQ ID NO: | Antisense-strand sequence (5'-3')[1] | SEQ ID NO: |
|---|---|---|---|---|
| AD-12041 | GccuGGAGuuuAuucGGAATsT | 1317 | UUCcGAAUAAACUCCAGGCTsT | 1318 |
| AD-12042 | GCCUGGAGUUUAUUCGGAATsT | 1319 | uUCCGAAUAAACUCCAGGCTsT | 1320 |
| AD-12043 | GCCUGGAGUUUAUUCGGAATsT | 1321 | UuCCGAAUAAACUCCAGGCTsT | 1322 |
| AD-12044 | GCCUGGAGUUUAUUCGGAATsT | 1323 | UUcCGAAUAAACUCCAGGCTsT | 1324 |
| AD-12045 | GCCUGGAGUUUAUUCGGAATsT | 1325 | UUCcGAAUAAACUCCAGGCTsT | 1326 |
| AD-12046 | GccuGGAGuuuAuucGGAA | 1327 | UUCCGAAUAAACUCCAGGCscsu | 1328 |
| AD-12047 | GccuGGAGuuuAuucGGAAA | 1329 | UUUCCGAAUAAACUCCAGGCscsu | 1330 |
| AD-12048 | GccuGGAGuuuAuucGGAAAA | 1331 | UUUUCCGAAUAAACUCCAGGCscsu | 1332 |
| AD-12049 | GccuGGAGuuuAuucGGAAAAG | 1333 | CUUUUCCGAAUAAACUCCAGGCscsu | 1334 |
| AD-12050 | GccuGGAGuuuAuucGGAATTab | 1335 | UUCCGAAUAAACUCCAGGCTTab | 1336 |
| AD-12051 | GccuGGAGuuuAuucGGAAATTab | 1337 | UUUCCGAAuAAACUCCAGGCTTab | 1338 |
| AD-12052 | GccuGGAGuuuAuucGGAAAATTab | 1339 | UUUUCCGAAUAAACUCCAGGCTTab | 1340 |
| AD-12053 | GccuGGAGuuuAuucGGAAAAGTTab | 1341 | CUUUUCCGAAUAAACUCCAGGCTTab | 1342 |
| AD-12054 | GCCUGGAGUUUAUUCGGAATsT | 1343 | UUCCGAAUAAACUCCAGGCscsu | 1344 |
| AD-12055 | GccuGGAGuuuAuucGGAATsT | 1345 | UUCCGAAUAAACUCCAGGCscsu | 1346 |
| AD-12056 | GcCuGgAgUuUaUuCgGaA | 1347 | UUCCGAAUAAACUCCAGGCTTab | 1348 |
| AD-12057 | GcCuGgAgUuUaUuCgGaA | 1349 | UUCCGAAUAAACUCCAGGCTsT | 1350 |
| AD-12058 | GcCuGgAgUuUaUuCgGaA | 1351 | UUCCGAAuAAACUCcAGGCTsT | 1352 |
| AD-12059 | GcCuGgAgUuUaUuCgGaA | 1353 | uUcCGAAuAAACUccAGGCTsT | 1354 |
| AD-12060 | GcCuGgAgUuUaUuCgGaA | 1355 | UUCCGaaUAaaCUCCAggc | 1356 |
| AD-12061 | GcCuGgnAgUuUaUuCgGaATsT | 1357 | UUCCGaaUAaaCUCCAggcTsT | 1358 |
| AD-12062 | GcCuGgAgUuUaUuCgGaATTab | 1359 | UUCCGaaUAaaCUCCAggcTTab | 1360 |
| AD-12063 | GcCuGgAgUuUaUuCgGaA | 1361 | UUCCGaaUAaaCUCCAggcscsu | 1362 |
| AD-12064 | GcCuGgnAgUuUaUuCgGaATsT | 1363 | UUCCGAAuAAACUCcAGGCTsT | 1364 |
| AD-12065 | GcCuGgAgUuUaUuCgGaATTab | 1365 | UUCCGAAuAAACUCcAGGCTTab | 1366 |
| AD-12066 | GcCuGgAgUuUaUuCgGaA | 1367 | UUCCGAAuAAACUCcAGGCscsu | 1368 |
| AD-12067 | GcCuGgnAgUuUaUuCgGaATsT | 1369 | UUCCGAAUAAACUCCAGGCTsT | 1370 |
| AD-12068 | GcCuGgAgUuUaUuCgGaATTab | 1371 | UUCCGAAUAAACUCCAGGCTTab | 1372 |
| AD-12069 | GcCuGgAgUuUaUuCgGaA | 1373 | UUCCGAAUAAACUCCAGGCscsu | 1374 |
| AD-12338 | GfcCfuGfgAfgUfuUfaUfuCfgGfaAf | 1375 | P-uUfcCfgAfaUfaAfaCfuCfcAfgGfc | 1376 |
| AD-12339 | GcCuGgAgUuUaUuCgGaA | 1377 | P-uUfcCfgAfaUfaAfaCfuCfcAfgGfc | 1378 |
| AD-12340 | GccuGGAGuuuAuucGGAA | 1379 | P-uUfcCfgAfaUfaAfaCfuCfcAfgGfc | 1380 |
| AD-12341 | GfcCfuGfgAfgUfuUfaUfuCfgGfaAfTsT | 1381 | P-uUfcCfgAfaUfaAfaCfuCfcAfgGfcTsT | 1382 |
| AD-12342 | GfcCfuGfgAfgUfuUfaUfuCfgGfaAfTsT | 1383 | UUCCGAAuAAACUCcAGGCTsT | 1384 |
| AD-12343 | GfcCfuGfgAfgUfuUfaUfuCfgGfaAfTsT | 1385 | uUcCGAAuAAACUccAGGCTsT | 1386 |
| AD-12344 | GfcCfuGfgAfgUfuUfaUfuCfgGfaAfTsT | 1387 | UUCCGAAUAAACUCCAGGCTsT | 1388 |
| AD-12345 | GfcCfuGfgAfgUfuUfaUfuCfgGfaAfTsT | 1389 | UUCCGAAUAAACUCCAGGCscsu | 1390 |

TABLE 2a-continued

Sequences of modified dsRNA targeted to PCSK9

| Duplex number | Sense strand sequence (5'-3')[1] | SEQ ID NO: | Antisense-strand sequence (5'-3')[1] | SEQ ID NO: |
|---|---|---|---|---|
| AD-12346 | GfcCfuGfgAfgUfuUfaUfuCfgGfaAfTsT | 1391 | UUCCGaaUAaaCUCCAggcscsu | 1392 |
| AD-12347 | GCCUGGAGUUUAUUCGGAATsT | 1393 | P-uUfcCfgAfaUfaAfaCfuCfcAfgGfcTsT | 1394 |
| AD-12348 | GccuGGAGuuuAuucGGAATsT | 1395 | P-uUfcCfgAfaUfaAfaCfuCfcAfgGfcTsT | 1396 |
| AD-12349 | GcCuGgnAgUuUaUuCgGaATsT | 1397 | P-uUfcCfgAfaUfaAfaCfuCfcAfgGfcTsT | 1398 |
| AD-12350 | GfcCfuGfgAfgUfuUfaUfuCfgGfaAfTTab | 1399 | P-uUfcCfgAfaUfaAfaCfuCfcAfgGfcTTab | 1400 |
| AD-12351 | GfcCfuGfgAfgUfuUfaUfuCfgGfaAf | 1401 | P-uUfcCfgAfaUfaAfaCfuCfcAfgGfcsCfsu | 1402 |
| AD-12352 | GfcCfuGfgAfgUfuUfaUfuCfgGfaAf | 1403 | UUCCGaaUAaaCUCCAggcscsu | 1404 |
| AD-12354 | GfcCfuGfgAfgUfuUfaUfuCfgGfaAf | 1405 | UUCCGAAUAAACUCCAGGCscsu | 1406 |
| AD-12355 | GfcCfuGfgAfgUfuUfaUfuCfgGfaAf | 1407 | UUCCGAAuAAACUCcAGGCTsT | 1408 |
| AD-12356 | GfcCfuGfgAfgUfuUfaUfuCfgGfaAf | 1409 | uUcCGAAuAAACUccAGGCTsT | 1410 |
| AD-12357 | GmocCmouGmogAm02gUmouUmoaUmouCmogGmoaA | 1411 | UUCCGaaUAaaCUCCAggc | 1412 |
| AD-12358 | GmocCmouGmogAm02gUmouUmoaUmouCmogGmoaA | 1413 | P-uUfcCfgAfaUfaAfaCfuCfcAfgGfc | 1414 |
| AD-12359 | GmocCmouGmogAm02gUmouUmoaUmouCmogGmoaA | 1415 | P-uUfcCfgAfaUfaAfaCfuCfcAfgGfcsCfsu | 1416 |
| AD-12360 | GmocCmouGmogAm02gUmouUmoaUmouCmogGmoaA | 1417 | UUCCGAAUAAACUCCAGGCscsu | 1418 |
| AD-12361 | GmocCmouGmogAm02gUmouUmoaUmouCmogGmoaA | 1419 | UUCCGAAUAAACUCcAGGCTsT | 1420 |
| AD-12362 | GmocCmouGmogAm02gUmouUmoaUmouCmogGmoaA | 1421 | uUcCGAAuAAACUccAGGCTsT | 1422 |
| AD-12363 | GmocCmouGmogAm02gUmouUmoaUmouCmogGmoaA | 1423 | UUCCGaaUAaaCUCCAggcscsu | 1424 |
| AD-12364 | GmocCmouGmogAmogUmouUmoaUmouCmogGmoaATsT | 1425 | UUCCGaaUAaaCUCCAggcTsT | 1426 |
| AD-12365 | GmocCmouGmogAmogUmouUmoaUmouCmogGmoaATsT | 1427 | UUCCGAAUAAACUCCAGGCTsT | 1428 |
| AD-12366 | GmocCmouGmogAmogUmouUmoaUmouCmogGmoaATsT | 1429 | UUCCGAAUAAACUCCAGGCTsT | 1430 |
| AD-12367 | GmocmocmouGGAGmoumoumouAmoumoumocGGAATsT | 1431 | UUCCGaaUAaaCUCCAggcTsT | 1432 |
| AD-12368 | GmocmocmouGGAGmoumoumouAmoumoumocGGAATsT | 1433 | UUCCGAAUAAACUCcAGGCTsT | 1434 |
| AD-12369 | GmocmocmouGGAGmoumoumouAmoumoumocGGAATsT | 1435 | UUCCGAAUAAACUCCAGGCTsT | 1436 |
| AD-12370 | GmocmocmouGGAGmoumoumouAmoumoumocGGAATsT | 1437 | P-UfUfCfCfGAAUfAAACfUfCfCfAGGCfTsT | 1438 |
| AD-12371 | GmocmocmouGGAGmoumoumouAmoumoumocGGAATsT | 1439 | P-UfUfCfCfGAAUfAAACfUfCfCfAGGCfsCfsUf | 1440 |
| AD-12372 | GmocmocmouGGAGmoumoumouAmoumoumocGGAATsT | 1441 | P-uUfcCfgAfaUfaAfaCfuCfcAfgGfcsCfsu | 1442 |
| AD-12373 | GmocmocmouGGAGmoumoumouAmoumoumocGGAATsT | 1443 | UUCCGAAUAAACUCCAGGCTsT | 1444 |
| AD-12374 | GCfCfUfGGAGUfUfUfAUfUfCfGGAATsT | 1445 | UfUfCfCfGAAUfAAACfUfCfCfAGGCfTsT | 1446 |
| AD-12375 | GCfCfUfGGAGUfUfUfAUfUfCfGGAATsT | 1447 | UUCCGAAUAAACUCCAGGCTsT | 1448 |

TABLE 2a-continued

Sequences of modified dsRNA targeted to PCSK9

| Duplex number | Sense strand sequence (5'-3')¹ | SEQ ID NO: | Antisense-strand sequence (5'-3')¹ | SEQ ID NO: |
|---|---|---|---|---|
| AD-12377 | GCfCfUfGGAGUfUfUfAUfUfCfGGAATsT | 1449 | uUcCGAAuAAACUccAGGCTsT | 1450 |
| AD-12378 | GCfCfUfGGAGUfUfUfAUfUfCfGGAATsT | 1451 | UUCCGaaUAaaCUCCAggcscsu | 1452 |
| AD-12379 | GCfCfUfGGAGUfUfUfAUfUfCfGGAATsT | 1453 | UUCCGAAUAAACUCCAGGCscsu | 1454 |
| AD-12380 | GCfCfUfGGAGUfUfUfAUfUfCfGGAATsT | 1455 | P-uUfcCfgAfaUfaAfaCfuCfcAfgGfcsCfsu | 1456 |
| AD-12381 | GCfCfUfGGAGUfUfUfAUfUfCfGGAATsT | 1457 | P-uUfcCfgAfaUfaAfaCfuCfcAfgGfcTsT | 1458 |
| AD-12382 | GCfCfUfGGAGUfUfUfAUfUfCfGGAATsT | 1459 | P-UfUfCfCfGAAUfAAACfUfCfCfAGGCfTsT | 1460 |
| AD-12383 | GCCUGGAGUUUAUUCGGAATsT | 1461 | P-UfUfCfCfGAAUfAAACfUfCfCfAGGCfTsT | 1462 |
| AD-12384 | GccuGGAGuuuAuucGGAATsT | 1463 | P-UfUfCfCfGAAUfAAACfUfCfCfAGGCfTsT | 1464 |
| AD-12385 | GcCuGgnAgUuUaUuCgGaATsT | 1465 | P-UfUfCfCfGAAUfAAACfUfCfCfAGGCfTsT | 1466 |
| AD-12386 | GfcCfuGfgAfgUfuUfaUfuCfgGfaAf | 1467 | P-UfUfCfCfGAAUfAAACfUfCfCfAGGCfTsT | 1468 |
| AD-12387 | GCfCfUfGGAGGUfUfUfAUfUfCfGGAA | 1469 | UfUfCfCfGAAUfAAACfUfCfCfAGGCfsCfsUf | 1470 |
| AD-12388 | GCfCfUfGGAGGUfUfUfAUfUfCfGGAA | 1471 | P-uUfcCfgAfaUfaAfaCfuCfcAfgGfc | 1472 |
| AD-12389 | GCfCfUfGGAGGUfUfUfAUfUfCfGGAA | 1473 | P-uUfcCfgAfaUfaAfaCfuCfcAfgGfcsCfsu | 1474 |
| AD-12390 | GCfCfUfGGAGGUfUfUfAUfUfCfGGAA | 1475 | UUCCGAAUAAACUCCAGGCscsu | 1476 |
| AD-12391 | GCfCfUfGGAGGUfUfUfAUfUfCfGGAA | 1477 | UUCCGaaUAaaCUCCAggc | 1478 |
| AD-12392 | GCfCfUfGGAGGUfUfUfAUfUfCfGGAA | 1479 | UUCCGAAUAAACUCCAGGCTsT | 1480 |
| AD-12393 | GCfCfUfGGAGGUfUfUfAUfUfCfGGAA | 1481 | UUCCGAAUAAACUCcAGGCTsT | 1482 |
| AD-12394 | GCfCfUfGGAGGUfUfUfAUfUfCfGGAA | 1483 | uUcCGAAuAAACUccAGGCTsT | 1484 |
| AD-12395 | GmocCmouGmogAmogUmouUmoaUmouCmogGmoaATsT | 1485 | P-UfUfCfCfGAAUfAAACfUfCfCfAGGCfsCfsUf | 1486 |
| AD-12396 | GmocCmouGmogAm02gUmouUmoaUmouCmogGmoaA | 1487 | P-UfUfCfCfGAAUfAAACfUfCfCfAGGCfsCfsUf | 1488 |
| AD-12397 | GfcCfuGfgAfgUfuUfaUfuCfgGfaAf | 1489 | P-UfUfCfCfGAAUfAAACfUfCfCfAGGCfsCfsUf | 1490 |
| AD-12398 | GfcCfuGfgAfgUfuUfaUfuCfgGfaAfTsT | 1491 | P-UfUfCfCfGAAUfAAACfUfCfCfAGGCfsCfsUf | 1492 |
| AD-12399 | GcCuGgnAgUuUaUuCgGaATsT | 1493 | P-UfUfCfCfGAAUfAAACfUfCfCfAGGCfsCfsUf | 1494 |
| AD-12400 | GCCUGGAGUUUAUUCGGAATsT | 1495 | P-UfUfCfCfGAAUfAAACfUfCfCfAGGCfsCfsUf | 1496 |
| AD-12401 | GccuGGAGuuuAuucGGAATsT | 1497 | P-UfUfCfCfGAAUfAAACfUfCfCfAGGCfsCfsUf | 1498 |
| AD-12402 | GccuGGAGuuuAuucGGAA | 1499 | P-UfUfCfCfGAAUfAAACfUfCfCfAGGCfsCfsUf | 1500 |
| AD-12403 | GCfCfUfGGAGGUfUfUfAUfUfCfGGAA | 1501 | P-UfUfCfCfGAAUfAAACfUfCfCfAGGCfsCfsUf | 1502 |
| AD-9314 | GCCUGGAGUUUAUUCGGAATsT | 1503 | UUCCGAAUAAACUCCAGGCTsT | 1504 |
| AD-10794 | ucAuAGGccuGGAGuuuAudTsdT | 1525 | AuAAACUCcAGGCCuAUGAdTsdT | 1526 |
| AD-10795 | ucAuAGGccuGGAGuuuAudTsdT | 1527 | AuAAACUCcAGGCcuAuGAdTsdT | 1528 |
| AD-10797 | ucAuAGGccuGGAGuuuAudTsdT | 1529 | AUAAACUCCAGGCCUAUGAdTsdT | 1530 |

U, C, A, G: corresponding ribonucleotide;
T: deoxythymidine;
u, c, a, g: corresponding 2'-O-methyl ribonucleotide;
Uf, Cf, Af, Gf: corresponding 2'-deoxy-2'-fluoro ribonucleotide;
moc, mou, mog, moa: corresponding 2'-MOE nucleotide; where nucleotides are written in sequence, they are connected by 3'-5' phosphodiester groups;
ab: 3'-terminal abasic nucleotide;
nucleotides with interjected "s" are connected by 3'-O-5'-O phosphorothiodiester groups; unless denoted by prefix "p-", oligonucleotides are devoid of a 5'-phosphate group on the 5'-most nucleotide; all oligonucleotides bear 3'-OH on the 3'-most nucleotide

TABLE 2b

Screening of dsRNAs targeted to PCSK9

| Duplex number | Remaining mRNA in % of controls at siRNA conc. of 30 nM |
|---|---|
| AD-10792 | 15 |
| AD-10793 | 32 |
| AD-10796 | 13 |
| AD-12038 | 13 |
| AD-12039 | 29 |
| AD-12040 | 10 |
| AD-12041 | 11 |
| AD-12042 | 12 |
| AD-12043 | 13 |
| AD-12044 | 7 |
| AD-12045 | 8 |
| AD-12046 | 13 |
| AD-12047 | 17 |
| AD-12048 | 43 |
| AD-12049 | 34 |
| AD-12050 | 16 |
| AD-12051 | 31 |
| AD-12052 | 81 |
| AD-12053 | 46 |
| AD-12054 | 8 |
| AD-12055 | 13 |
| AD-12056 | 11 |
| AD-12057 | 8 |
| AD-12058 | 9 |
| AD-12059 | 23 |
| AD-12060 | 10 |
| AD-12061 | 7 |
| AD-12062 | 10 |
| AD-12063 | 19 |
| AD-12064 | 15 |
| AD-12065 | 16 |
| AD-12066 | 20 |
| AD-12067 | 17 |
| AD-12068 | 18 |
| AD-12069 | 13 |
| AD-12338 | 15 |
| AD-12339 | 14 |
| AD-12340 | 19 |
| AD-12341 | 12 |
| AD-12342 | 13 |
| AD-12343 | 24 |
| AD-12344 | 9 |
| AD-12345 | 12 |
| AD-12346 | 13 |
| AD-12347 | 11 |
| AD-12348 | 8 |
| AD-12349 | 11 |
| AD-12350 | 17 |
| AD-12351 | 11 |
| AD-12352 | 11 |
| AD-12354 | 11 |
| AD-12355 | 9 |
| AD-12356 | 25 |
| AD-12357 | 56 |
| AD-12358 | 29 |
| AD-12359 | 30 |
| AD-12360 | 15 |
| AD-12361 | 20 |
| AD-12362 | 51 |
| AD-12363 | 11 |
| AD-12364 | 25 |
| AD-12365 | 18 |
| AD-12366 | 23 |
| AD-12367 | 42 |
| AD-12368 | 40 |
| AD-12369 | 26 |
| AD-12370 | 68 |
| AD-12371 | 60 |
| AD-12372 | 60 |
| AD-12373 | 55 |
| AD-12374 | 9 |
| AD-12375 | 16 |
| AD-12377 | 88 |
| AD-12378 | 6 |
| AD-12379 | 6 |
| AD-12380 | 8 |
| AD-12381 | 10 |
| AD-12382 | 7 |
| AD-12383 | 7 |
| AD-12384 | 8 |
| AD-12385 | 8 |
| AD-12386 | 11 |
| AD-12387 | 13 |
| AD-12388 | 19 |
| AD-12389 | 16 |
| AD-12390 | 17 |
| AD-12391 | 21 |
| AD-12392 | 28 |
| AD-12393 | 17 |
| AD-12394 | 75 |
| AD-12395 | 55 |
| AD-12396 | 59 |
| AD-12397 | 20 |
| AD-12398 | 11 |
| AD-12399 | 13 |
| AD-12400 | 12 |
| AD-12401 | 13 |
| AD-12402 | 14 |
| AD-12403 | 4 |
| AD-9314 | 9 |

TABLE 3

Cholesterol levels of rats treated with LNP01-10792
Dosage of 5 mg/kg, n = 6 rats per group

| Day | Total serum cholesterol (relative to PBS control) |
|---|---|
| 2 | 0.329 ± 0.035 |
| 4 | 0.350 ± 0.055 |
| 7 | 0.402 ± 0.09 |
| 9 | 0.381 ± 0.061 |
| 11 | 0.487 ± 0.028 |
| 14 | 0.587 ± 0.049 |
| 16 | 0.635 ± 0.107 |
| 18 | 0.704 ± 0.060 |
| 21 | 0.775 ± 0.102 |
| 28 | 0.815 ± 0.103 |

TABLE 4

Serum LDL-C levels of cynomolgus monkeys treated with LNP formulated dsRNAs

| | Serum LDL-C (relative to pre-dose) | | | | | |
|---|---|---|---|---|---|---|
| | Day 3 | Day 4 | Day 5 | Day 7 | Day 14 | Day 21 |
| PBS n = 3 | 1.053 ± 0.158 | 0.965 ± 0.074 | 1.033 ± 0.085 | 1.033 ± 0.157 | 1.009 ± 0.034 | |
| LNP01-1955 n = 3 | | 1.027 ± 0.068 | | 1.104 ± 0.114 | | |
| LNP01-10792 n = 5 | 0.503 ± 0.055 | 0.596 ± 0.111 | 0.674 ± 0.139 | 0.644 ± 0.121 | 0.958 ± 0.165 | 1.111 ± 0.172 |
| LNP01-9680 n = 4 | 0.542 ± 0.155 | 0.437 ± 0.076 | 0.505 ± 0.071 | 0.469 ± 0.066 | 0.596 ± 0.080 | 0.787 ± 0.138 |

TABLE 5a

Modified dsRNA targeted to PCSK9

| Name | Position in human access.# | Sense | Antisense | Sequence 5'-3' | SEQ ID NO: |
|---|---|---|---|---|---|
| AD-1a1 | 1091 | unmodified | unmodified | GCCUGGAGUUUAUUCGGAAdTdT<br>UUCCGAAUAAACUCCAGGCdTsdT | 1505<br>1506 |
| AD-1a2 | 1091 | 2'OMe | 2'OMe | GccuGGAGuuuAuucGGAAdTsdT<br>UUCCGAAuAAACUCcAGGCdTsdT | 1507<br>1508 |
| AD-1a3 | 1091 | Alt 2'F,<br>2'OMe | Alt 2'F,<br>2'OMe | GfcCfuGfgAfgUfuUfaUfuCfgGfaAfdTdT<br>puUfcCfgAfaUfaAfaCfuCfcAfgGfcdTsdT | 1509<br>1510 |
| AD-1a4 | 1091 | 2'OMe | 2'F all Py,<br>5'Phosphate | GccuGGAGuuuAuucGGAAdTsdT<br>PUfUfCfCfGAAUfAAACfUfCfCfAGGCfdTsdT | 1511<br>1512 |
| AD-1a5 | 1091 | 2'F | 2'F all Py,<br>5'Phosphate | GCfCfUfGGAGUfUfUfAUfUfCfGGAAdTsdT<br>PUfUfCfCfGAAUfAAACfUfCfCfAGGCfdTsdT | 1513<br>1514 |
| AD-2a1 | 3530<br>(3'UTR) | 2'OMe | 2'OMe | uucuAGAccuGuuuuGcuudTsdT<br>AAGcAAAAcAGGUCuAGAAdTsdT | 1515<br>1516 |
| AD-3a1 | 833 | 2'OMe | 2'OMe | AGGuGuAucuccuAGAcAcdTsdT<br>GUGUCuAGGAGAuAcACCUdTsdT | 1517<br>1518 |
| AD-ctrl (Luc.) | N/A | 2'OMe | 2'OMe | cuuAcGcuGAGuAcuucGAdTsdT<br>UCGAAGuACUcAGCGuAAGdTsdT | 1519<br>1520 |

U, C, A, G: corresponding ribonucleotide;
T: deoxythymidine;
u, c, a, g: corresponding 2'-O-methyl ribonucleotide;
Uf, Cf, Af, Gf: corresponding 2'-deoxy-2'-fluoro ribonucleotide; where nucleotides are written in sequence, they are connected by 3'-5' phosphodiester groups; nucleotides with interjected "s" are connected by 3'-O-5'-O phosphorothiodiester groups; unless denoted by prefix "p-", oligonucleotides are devoid of a 5'-phosphate group on the 5'-most nucleotide; all oligonucleotides bear 3'-OH on the 3'-most nucleotide.

TABLE 5b

Silencing activity of modified dsRNA in monkey hepatocytes

| Name | Position in human access.# | IFN-α/TNF-α Induction | Sense | Antisense | Primary Cynomolgus Monkey Hepatocytes ~IC50, nM |
|---|---|---|---|---|---|
| AD-1a1 | 1091 | Yes/Yes | unmodified | unmodified | 0.07-0.2 |
| AD-1a2 | 1091 | No/No | 2'OMe | 2'OMe | 0.07-0.2 |
| AD-1a3 | 1091 | No/No | Alt 2'F, 2'OMe | Alt 2'F, 2'OMe | 0.07-0.2 |
| AD-1a4 | 1091 | No/No | 2'OMe | 2'F all Py, 5'Phosphate | 0.07-0.2 |
| AD-1a5 | 1091 | No/No | 2'F | 2'F all Py, 5'Phosphate | 0.07-0.2 |
| AD-2a1 | 3530 (3'UTR) | No/No | 2'OMe | 2'OMe | 0.07-0.2 |
| AD-3a1 | 833 | No/No | 2'OMe | 2'OMe | 0.1-0.3 |
| AD-ctrl (Luc.) | N/A | No/No | 2'OMe | 2'OMe | N/A |

TABLE 6 dsRNA targeted to PCSK9: mismatches and modifications

| Duplex # | Strand | SEQ ID NO: | Sequence 5' to 3' |
|---|---|---|---|
| AD-9680 | S | 1531 | uucuAGAccuGuuuuGcuudTsdT |
|  | AS | 1532 | AAGcAAAAcAGGUCuAGAAdTsdT |
| AD-3267 | S | 1535 | uucuAGAcCuGuuuuGcuuTsT |
|  | AS | 1536 | AAGcAAAAcAGGUCuAGAATsT |
| AD-3268 | S | 1537 | uucuAGAccUGuuuuGcuuTsT |
|  | AS | 1538 | AAGcAAAAcAGGUCuAGAATsT |
| AD-3269 | S | 1539 | uucuAGAcCUGuuuuGcuuTsT |
|  | AS | 1540 | AAGcAAAAcAGGUCuAGAATsT |
| AD-3270 | S | 1541 | uucuAGAcY1uGuuuuGcuuTsT |
|  | AS | 1542 | AAGcAAAAcAGGUCuAGAATsT |
| AD-3271 | S | 1543 | uucuAGAcY1UGuuuuGcuuTsT |
|  | AS | 1544 | AAGcAAAAcAGGUCuAGAATsT |
| AD-3272 | S | 1545 | uucuAGAccY1GuuuuGcuuTsT |
|  | AS | 1546 | AAGcAAAAcAGGUCuAGAATsT |
| AD-3273 | S | 1547 | uucuAGAcCY1GuuuuGcuuTsT |
|  | AS | 1548 | AAGcAAAAcAGGUCuAGAATsT |
| AD-3274 | S | 1549 | uucuAGAccuY1uuuuGcuuTsT |
|  | AS | 1550 | AAGcAAAAcAGGUCuAGAATsT |
| AD-3275 | S | 1551 | uucuAGAcCUY1uuuuGcuuTsT |
|  | AS | 1552 | AAGcAAAAcAGGUCuAGAATsT |
| AD-14676 | S | 1553 | UfuCfuAfgAfcCfuGfuUfuUfgCfuUfTsT |
|  | AS | 1554 | p-aAfgCfaAfaAfcAfgGfuCfuAfgAfaTsT |
| AD-3276 | S | 1555 | UfuCfuAfgAfcCuGfuUfuUfgCfuUfTsT |
|  | AS | 1556 | p-aAfgCfaAfaAfcAfgGfuCfuAfgAfaTsT |
| AD-3277 | S | 1557 | UfuCfuAfgAfcCfUGfuUfuUfgCfuUfTsT |
|  | AS | 1558 | p-aAfgCfaAfaAfcAfgGfuCfuAfgAfaTsT |
| AD-3278 | S | 1559 | UfuCfuAfgAfcCUGfuUfuUfgCfuUfTsT |
|  | AS | 1560 | p-aAfgCfaAfaAfcAfgGfuCfuAfgAfaTsT |
| AD-3279 | S | 1561 | UfuCfuAfgAfcY1uGfuUfuUfgCfuUfTsT |
|  | AS | 1562 | p-aAfgCfaAfaAfcAfgGfuCfuAfgAfaTsT |
| AD-3280 | S | 1563 | UfuCfuAfgAfcY1UGfuUfuUfgCfuUfTsT |
|  | AS | 1564 | p-aAfgCfaAfaAfcAfgGfuCfuAfgAfaTsT |
| AD-3281 | S | 1565 | UfuCfuAfgAfcCfY1GfuUfuUfgCfuUfTsT |
|  | AS | 1566 | p-aAfgCfaAfaAfcAfgGfuCfuAfgAfaTsT |
| AD-3282 | S | 1567 | UfuCfuAfgAfcCY1GfuUfuUfgCfuUfTsT |
|  | AS | 1568 | p-aAfgCfaAfaAfcAfgGfuCfuAfgAfaTsT |
| AD-3283 | S | 1569 | UfuCfuAfgAfcCfuY1uUfuUfgCfuUfTsT |
|  | AS | 1570 | p-aAfgCfaAfaAfcAfgGfuCfuAfgAfaTsT |
| AD-3284 | S | 1571 | UfuCfuAfgAfcCUY1uUfuUfgCfuUfTsT |
|  | AS | 1572 | p-aAfgCfaAfaAfcAfgGfuCfuAfgAfaTsT |
| AD-10792 | S | 459 | GccuGGAGuuuAuucGGAATsT |
|  | AS | 460 | UUCCGAAuAAACUCcAGGCTsT |
| AD-3254 | S | 1573 | GccuGGAGuY1AuucGGAATsT |
|  | AS | 1574 | UUCCGAAuAAACUCcAGGCTsT |

TABLE 6-continued dsRNA targeted to PCSK9: mismatches and modifications

| Duplex # | Strand | SEQ ID NO: | Sequence 5' to 3' |
|---|---|---|---|
| AD-3255 | S | 1575 | GccuGGAGUY1uAuucGGAATsT |
|  | AS | 1576 | UUCCGAAuAAACUCcAGGCTsT |

Strand: S/Sense; AS/Antisense
U, C, A, G: corresponding ribonucleotide;
T: deoxythymidine;
u, c, a, g: corresponding 2'-O-methyl ribonucleotide;
Uf, Cf, Af, Gf: corresponding 2'-deoxy-2'-fluoro ribonucleotide;
Y1 corresponds to DFT difluorotoluyl ribo(or deoxyribo)nucleotide; where nucleotides are written in sequence, they are connected by 3'-5' phosphodiester groups;
nucleotides with interjected "s" are connected by 3'-O-5'-O phosphorothiodiester groups; unless denoted by prefix "p-", oligonucleotides are devoid of a 5'-phosphate group on the 5'-most nucleotide; all oligonucleotides bear 3'-OH on the 3'-most nucleotide

TABLE 7

Sequences of unmodified siRNA flanking AD-9680

| Duplex | Type | Sequence (5' to 3') | Target site | SEQ ID NO: |
|---|---|---|---|---|
| AD-22169-b1 | sense | CAGCCAACUUUUCUAGACCdTsdT | 3520 | 1577 |
|  | antis | GGUCUAGAAAAGUUGGCUGdTsdT | 3520 | 1578 |
| AD-22170-b1 | sense | AGCCAACUUUUCUAGACCUdTsdT | 3521 | 1579 |
|  | antis | AGGUCUAGAAAAGUUGGCUdTsdT | 3521 | 1580 |
| AD-22171-b1 | sense | GCCAACUUUUCUAGACCUGdTsdT | 3522 | 1581 |
|  | antis | CAGGUCUAGAAAAGUUGGCdTsdT | 3522 | 1582 |
| AD-22172-b1 | sense | CCAACUUUUCUAGACCUGUdTsdT | 3523 | 1583 |
|  | antis | ACAGGUCUAGAAAAGUUGGdTsdT | 3523 | 1584 |
| AD-22173-b1 | sense | CAACUUUUCUAGACCUGUUdTsdT | 3524 | 1585 |
|  | antis | AACAGGUCUAGAAAAGUUGdTsdT | 3524 | 1586 |
| AD-22174-b1 | sense | AACUUUUCUAGACCUGUUUdTsdT | 3525 | 1587 |
|  | antis | AAACAGGUCUAGAAAAGUUdTsdT | 3525 | 1588 |
| AD-22175-b1 | sense | ACUUUUCUAGACCUGUUUUdTsdT | 3526 | 1589 |
|  | antis | AAAACAGGUCUAGAAAAGUdTsdT | 3526 | 1590 |
| AD-22176-b1 | sense | CUUUUCUAGACCUGUUUUGdTsdT | 3527 | 1591 |
|  | antis | CAAAACAGGUCUAGAAAAGdTsdT | 3527 | 1592 |
| AD-22177-b1 | sense | UUUUCUAGACCUGUUUUGCdTsdT | 3528 | 1593 |
|  | antis | GCAAAACAGGUCUAGAAAAdTsdT | 3528 | 1594 |
| AD-22178-b1 | sense | UUUCUAGACCUGUUUUGCUdTsdT | 3529 | 1595 |
|  | antis | AGCAAAACAGGUCUAGAAAdTsdT | 3529 | 1596 |
| AD-22179-b1 | sense | UCUAGACCUGUUUUGCUUUdTsdT | 3531 | 1597 |
|  | antis | AAAGCAAAACAGGUCUAGAdTsdT | 3531 | 1598 |
| AD-22180-b1 | sense | CUAGACCUGUUUUGCUUUUdTsdT | 3532 | 1599 |
|  | antis | AAAAGCAAAACAGGUCUAGdTsdT | 3532 | 1600 |
| AD-22181-b1 | sense | UAGACCUGUUUUGCUUUUGdTsdT | 3533 | 1601 |
|  | antis | CAAAAGCAAAACAGGUCUAdTsdT | 3533 | 1602 |
| AD-22182-b1 | sense | AGACCUGUUUUGCUUUUGUdTsdT | 3534 | 1603 |
|  | antis | ACAAAAGCAAAACAGGUCUdTsdT | 3534 | 1604 |
| AD-22183-b1 | sense | GACCUGUUUUGCUUUUGUAdTsdT | 3535 | 1605 |
|  | antis | UACAAAAGCAAAACAGGUCdTsdT | 3535 | 1606 |
| AD-22184-b1 | sense | ACCUGUUUUGCUUUUGUAAdTsdT | 3536 | 1607 |
|  | antis | UUACAAAAGCAAAACAGGUdTsdT | 3536 | 1608 |
| AD-22185-b1 | sense | CCUGUUUUGCUUUUGUAACdTsdT | 3537 | 1609 |
|  | antis | GUUACAAAAGCAAAACAGGdTsdT | 3537 | 1610 |
| AD-22186-b1 | sense | CUGUUUUGCUUUUGUAACUdTsdT | 3538 | 1611 |
|  | antis | AGUUACAAAAGCAAAACAGdTsdT | 3538 | 1612 |

TABLE 7-continued

Sequences of unmodified siRNA flanking AD-9680

| Duplex | Type | Sequence (5' to 3') | Target site | SEQ ID NO: |
|---|---|---|---|---|
| AD-22187-b1 | sense | UGUUUUGCUUUUGUAACUUGdTsdT | 3539 | 1613 |
| | antis | AAGUUACAAAAGCAAAACAdTsdT | 3539 | 1614 |
| AD-22188-b1 | sense | GUUUUGCUUUUGUAACUUGdTsdT | 3540 | 1615 |
| | antis | CAAGUUACAAAAGCAAAACdTsdT | 3540 | 1616 |
| AD-22189-b1 | sense | UUUUGCUUUUGUAACUUGAdTsdT | 3541 | 1617 |
| | antis | UCAAGUUACAAAAGCAAAAdTsdT | 3541 | 1618 |
| AD-22190-b1 | sense | UUUGCUUUUGUAACUUGAAdTsdT | 3542 | 1619 |
| | antis | UUCAAGUUACAAAAGCAAAdTsdT | 3542 | 1620 |
| AD-22191-b1 | sense | UUGCUUUUGUAACUUGAAGdTsdT | 3543 | 1621 |
| | antis | CUUCAAGUUACAAAAGCAAdTsdT | 3543 | 1622 |
| AD-22192-b1 | sense | UGCUUUUGUAACUUGAAGAdTsdT | 3544 | 1623 |
| | antis | UCUUCAAGUUACAAAAGCAdTsdT | 3544 | 1624 |
| AD-22193-b1 | sense | GCUUUUGUAACUUGAAGAUdTsdT | 3545 | 1625 |
| | antis | AUCUUCAAGUUACAAAAGCdTsdT | 3545 | 1626 |
| AD-22194-b1 | sense | CUUUUGUAACUUGAAGAUAdTsdT | 3546 | 1627 |
| | antis | UAUCUUCAAGUUACAAAAGdTsdT | 3546 | 1628 |
| AD-22195-b1 | sense | UUUUGUAACUUGAAGAUAUdTsdT | 3547 | 1629 |
| | antis | AUAUCUUCAAGUUACAAAAdTsdT | 3547 | 1630 |
| AD-22196-b1 | sense | UUUGUAACUUGAAGAUAUUdTsdT | 3548 | 1631 |
| | antis | AAUAUCUUCAAGUUACAAAdTsdT | 3548 | 1632 |
| AD-22197-b1 | sense | UUGUAACUUGAAGAUAUUUdTsdT | 3549 | 1633 |
| | antis | AAAUAUCUUCAAGUUACAAdTsdT | 3549 | 1634 |
| AD-22198-b1 | sense | UGUAACUUGAAGAUAUUUAdTsdT | 3550 | 1635 |
| | antis | UAAAUAUCUUCAAGUUACAdTsdT | 3550 | 1636 |
| AD-22199-b1 | sense | GUAACUUGAAGAUAUUUAUdTsdT | 3551 | 1637 |
| | antis | AUAAAUAUCUUCAAGUUACdTsdT | 3551 | 1638 |
| AD-22200-b1 | sense | UAACUUGAAGAUAUUUAUUdTsdT | 3552 | 1639 |
| | antis | AAUAAAUAUCUUCAAGUUAdTsdT | 3552 | 1640 |
| AD-22201-b1 | sense | AACUUGAAGAUAUUUAUUCdTsdT | 3553 | 1641 |
| | antis | GAAUAAAUAUCUUCAAGUUdTsdT | 3553 | 1642 |
| AD-22202-b1 | sense | ACUUGAAGAUAUUUAUUCUdTsdT | 3554 | 1643 |
| | antis | AGAAUAAAUAUCUUCAAGUdTsdT | 3554 | 1644 |
| AD-22203-b1 | sense | CUUGAAGAUAUUUAUUCUGdTsdT | 3555 | 1645 |
| | antis | CAGAAUAAAUAUCUUCAAGdTsdT | 3555 | 1646 |
| AD-22204-b1 | sense | UUGAAGAUAUUUAUUCUGGdTsdT | 3556 | 1647 |
| | antis | CCAGAAUAAAUAUCUUCAAdTsdT | 3556 | 1648 |
| AD-22205-b1 | sense | UGAAGAUAUUUAUUCUGGGdTsdT | 3557 | 1649 |
| | antis | CCCAGAAUAAAUAUCUUCAdTsdT | 3557 | 1650 |
| AD-22206-b1 | sense | GAAGAUAUUUAUUCUGGGUdTsdT | 3558 | 1651 |
| | antis | ACCCAGAAUAAAUAUCUUCdTsdT | 3558 | 1652 |

TABLE 8

Sequences of modified siRNA flanking AD-9680

| Duplex | Type | Sequence (5' to 3') | Target | SEQ ID NO: |
|---|---|---|---|---|
| AD-22098-b1 | sense | cAGccAAcuuuucuAGAccdTsdT | 3520 | 1653 |
| | antis | GGUCuAGAAAAGUUGGCUGdTsdT | 3520 | 1654 |
| AD-22099-b1 | sense | AGccAAcuuuucuAGAccudTsdT | 3521 | 1655 |
| | antis | AGGUCuAGAAAAGUUGGCUdTsdT | 3521 | 1656 |

TABLE 8-continued

Sequences of modified siRNA flanking AD-9680

| Duplex | Type | Sequence (5' to 3') | Target | SEQ ID NO: |
|---|---|---|---|---|
| AD-22100-b1 | sense | GccAAcuuuucuAGAccuGudTsdT | 3522 | 1657 |
|  | antis | cAGGUCuAGAAAAGUUGGCdTsdT | 3522 | 1658 |
| AD-22101-b1 | sense | ccAAcuuuucuAGAccuGudTsdT | 3523 | 1659 |
|  | antis | AcAGGUCuAGAAAAGUUGGdTsdT | 3523 | 1660 |
| AD-22102-b1 | sense | cAAcuuuucuAGAccuGuudTsdT | 3524 | 1661 |
|  | antis | AAcAGGUCuAGAAAAGUUGdTsdT | 3524 | 1662 |
| AD-22103-b1 | sense | AAcuuuucuAGAccuGuuudTsdT | 3525 | 1663 |
|  | antis | AAAcAGGUCuAGAAAAGUUdTsdT | 3525 | 1664 |
| AD-22104-b1 | sense | AcuuuucuAGAccuGuuuudTsdT | 3526 | 1665 |
|  | antis | AAAAcAGGUCuAGAAAAGUdTsdT | 3526 | 1666 |
| AD-22105-b1 | sense | cuuuucuAGAccuGuuuuGdTsdT | 3527 | 1667 |
|  | antis | cAAAAcAGGUCuAGAAAAGdTsdT | 3527 | 1668 |
| AD-22106-b1 | sense | uuuucuAGAccuGuuuuGcdTsdT | 3528 | 1669 |
|  | antis | GcAAAAcAGGUCuAGAAAAdTsdT | 3528 | 1670 |
| AD-22107-b1 | sense | uuucuAGAccuGuuuuGcudTsdT | 3529 | 1671 |
|  | antis | AGcAAAAcAGGUCuAGAAAdTsdT | 3529 | 1672 |
| AD-22108-b1 | sense | ucuAGAccuGuuuuGcuuudTsdT | 3531 | 1673 |
|  | antis | AAAGcAAAAcAGGUCuAGAdTsdT | 3531 | 1674 |
| AD-22109-b1 | sense | cuAGAccuGuuuuGcuuuudTsdT | 3532 | 1675 |
|  | antis | AAAAGcAAAAcAGGUCuAGdTsdT | 3532 | 1676 |
| AD-22110-b1 | sense | uAGAccuGuuuuGcuuuuGdTsdT | 3533 | 1677 |
|  | antis | cAAAAGcAAAAcAGGUCuAdTsdT | 3533 | 1678 |
| AD-22111-b1 | sense | AGAccuGuuuuGcuuuuGudTsdT | 3534 | 1679 |
|  | antis | AcAAAAGcAAAAcAGGUCUdTsdT | 3534 | 1680 |
| AD-22112-b1 | sense | GAccuGuuuuGcuuuuGuAdTsdT | 3535 | 1681 |
|  | antis | uAcAAAAGcAAAAcAGGUCdTsdT | 3535 | 1682 |
| AD-22113-b1 | sense | AccuGuuuuGcuuuuGuAAdTsdT | 3536 | 1683 |
|  | antis | UuAcAAAAGcAAAAcAGGUdTsdT | 3536 | 1684 |
| AD-22114-b1 | sense | ccuGuuuuGcuuuuGuAAcdTsdT | 3537 | 1685 |
|  | antis | GUuAcAAAAGcAAAAcAGGdTsdT | 3537 | 1686 |
| AD-22115-b1 | sense | cuGuuuuGcuuuuGuAAcudTsdT | 3538 | 1687 |
|  | antis | AGUuAcAAAAGcAAAAcAGdTsdT | 3538 | 1688 |
|  | sense | uGuuuuGcuuuuGuAAcuudTsdT | 3539 | 1689 |
|  | antis | AAGUuAcAAAAGcAAAAcAdTsdT | 3539 | 1690 |
| AD-22116-b1 | sense | GuuuuGcuuuuGuAAcuuGdTsdT | 3540 | 1691 |
|  | antis | cAAGUuAcAAAAGcAAAAcdTsdT | 3540 | 1692 |
| AD-22117-b1 | sense | uuuuGcuuuuGuAAcuuGAdTsdT | 3541 | 1693 |
|  | antis | UcAAGUuAcAAAAGcAAAAdTsdT | 3541 | 1694 |
| AD-22118-b1 | sense | uuuGcuuuuGuAAcuuGAAdTsdT | 3542 | 1695 |
|  | antis | UUcAAGUuAcAAAAGcAAAdTsdT | 3542 | 1696 |
| AD-22119-b1 | sense | uuGcuuuuGuAAcuuGAAGdTsdT | 3543 | 1697 |
|  | antis | CUUcAAGUuAcAAAAGcAAdTsdT | 3543 | 1698 |
| AD-22120-b1 | sense | uGcuuuuGuAAcuuGAAGAdTsdT | 3544 | 1699 |
|  | antis | UCUUcAAGUuAcAAAAGcAdTsdT | 3544 | 1700 |
| AD-22121-b1 | sense | GcuuuuGuAAcuuGAAGAudTsdT | 3545 | 1701 |
|  | antis | AUCUUcAAGUuAcAAAAGCdTsdT | 3545 | 1702 |
| AD-22122-b1 | sense | cuuuuGuAAcuuGAAGAuAdTsdT | 3546 | 1703 |
|  | antis | uAUCUUcAAGUuAcAAAAGdTsdT | 3546 | 1704 |
| AD-22123-b1 | sense | uuuuGuAAcuuGAAGAuAudTsdT | 3547 | 1705 |
|  | antis | AuAUCUUcAAGUuAcAAAAdTsdT | 3547 | 1706 |

TABLE 8-continued

Sequences of modified siRNA flanking AD-9680

| Duplex | Type | Sequence (5' to 3') | Target | SEQ ID NO: |
|---|---|---|---|---|
| AD-22124-b1 | sense | uuuGuAAcuuGAAGAuAuuudTsdT | 3548 | 1707 |
| | antis | AAuAUCUUcAAGUuAcAAAdTsdT | 3548 | 1708 |
| AD-22125-b1 | sense | uuGuAAcuuGAAGAuAuuudTsdT | 3549 | 1709 |
| | antis | AAAuAUCUUcAAGUuAcAAdTsdT | 3549 | 1710 |
| AD-22126-b1 | sense | uGuAAcuuGAAGAuAuuuAdTsdT | 3550 | 1711 |
| | antis | uAAAuAUCUUcAAGUuAcAdTsdT | 3550 | 1712 |
| AD-22127-b1 | sense | GuAAcuuGAAGAuAuuuAudTsdT | 3551 | 1713 |
| | antis | AuAAAuAUCUUcAAGUuACdTsdT | 3551 | 1714 |
| AD-22128-b1 | sense | uAAcuuGAAGAuAuuuAuudTsdT | 3552 | 1715 |
| | antis | AAuAAAuAUCUUcAAGUuAdTsdT | 3552 | 1716 |
| AD-22129-b1 | sense | AAcuuGAAGAuAuuuAuucdTsdT | 3553 | 1717 |
| | antis | GAAuAAAuAUCUUcAAGUUdTsdT | 3553 | 1718 |
| AD-22130-b1 | sense | AcuuGAAGAuAuuuAuucudTsdT | 3554 | 1719 |
| | antis | AGAAuAAAuAUCUUcAAGUdTsdT | 3554 | 1720 |
| AD-22131-b1 | sense | cuuGAAGAuAuuuAuucuGdTsdT | 3555 | 1721 |
| | antis | cAGAAuAAAuAUCUUcAAGdTsdT | 3555 | 1722 |
| AD-22132-b1 | sense | uuGAAGAuAuuuAuucuGGdTsdT | 3556 | 1723 |
| | antis | CcAGAAuAAAuAUCUUcAAdTsdT | 3556 | 1724 |
| AD-22133-b1 | sense | uGAAGAuAuuuAuucuGGGdTsdT | 3557 | 1725 |
| | antis | CCcAGAAuAAAuAUCUUcAdTsdT | 3557 | 1726 |
| AD-22134-b1 | sense | GAAGAuAuuuAuucuGGGudTsdT | 3558 | 1727 |
| | antis | ACCcAGAAuAAAuAUCUUCdTsdT | 3558 | 1728 |

TABLE 9

Single dose treatment of HeLa cells with siRNA flanking AD-9680

| Duplex ID | % message remaining 0.1 nM | SD 0.1 nM | % message remaining 10 nM | SD 10 nM |
|---|---|---|---|---|
| AD-22098-b1 | 10.6 | 1.9 | 9.2 | 3.7 |
| AD-22098-b1 | 7.7 | 1.7 | 7.9 | 0.7 |
| AD-22099-b1 | 21.3 | 4.5 | 27.4 | 7.2 |
| AD-22099-b1 | 25.9 | 2.4 | 29.6 | 9.1 |
| AD-22100-b1 | 58.6 | 9.6 | 35.8 | 11.1 |
| AD-22100-b1 | 62.5 | 0.3 | 27.4 | 3.5 |
| AD-22101-b1 | 21.9 | 3.8 | 12.9 | 1.4 |
| AD-22101-b1 | 19.3 | 0.3 | 9.7 | 1.3 |
| AD-22102-b1 | 6.6 | 0.1 | 7.7 | 3.3 |
| AD-22103-b1 | 8.7 | 0.0 | 8.2 | 1.3 |
| AD-22104-b1 | 7.6 | 0.2 | 8.5 | 2.8 |
| AD-22105-b1 | 13.4 | 1.0 | 8.1 | 2.3 |
| AD-22106-b1 | 59.1 | 0.4 | 35.4 | 4.6 |
| AD-22107-b1 | 9.1 | 0.8 | 8.4 | 3.7 |
| AD-22108-b1 | 8.8 | 0.9 | 6.2 | 1.7 |
| AD-22109-b1 | 9.8 | 0.9 | 8.2 | 1.7 |
| AD-22110-b1 | 24.8 | 1.7 | 15.3 | 5.9 |
| AD-22111-b1 | 8.3 | 0.7 | 6.2 | 1.7 |
| AD-22112-b1 | 15.1 | 0.0 | 10.3 | 2.9 |
| AD-22113-b1 | 10.9 | 0.6 | 10.0 | 2.0 |
| AD-22114-b1 | 8.9 | 1.1 | 7.3 | 1.3 |
| AD-22115-b1 | 5.3 | 0.8 | 3.7 | 0.7 |
| AD-22116-b1 | 58.1 | 0.4 | 34.5 | 7.3 |
| AD-22117-b1 | 19.9 | 0.9 | 12.2 | 2.9 |
| AD-22118-b1 | 5.3 | 0.0 | 4.4 | 1.0 |
| AD-22119-b1 | 8.6 | 1.9 | 5.8 | 2.3 |
| AD-22120-b1 | 7.2 | 0.8 | 5.8 | 2.4 |
| AD-22121-b1 | 7.3 | 0.9 | 6.4 | 2.1 |
| AD-22122-b1 | 32.5 | 2.5 | 18.1 | 6.3 |
| AD-22123-b1 | 14.7 | 0.8 | 16.7 | 7.0 |
| AD-22124-b1 | 12.8 | 1.9 | 10.5 | 5.3 |
| AD-22125-b1 | 7.4 | 0.6 | 9.0 | 4.6 |
| AD-22126-b1 | 12.8 | 0.4 | 16.4 | 7.3 |
| AD-22127-b1 | 8.8 | 0.5 | 9.6 | 5.0 |
| AD-22128-b1 | 9.9 | 0.2 | 12.4 | 5.9 |
| AD-22129-b1 | 85.9 | 10.3 | 94.9 | 49.8 |
| AD-22130-b1 | 5.6 | 1.0 | 6.2 | 4.1 |
| AD-22131-b1 | 26.9 | 8.4 | 12.9 | 7.3 |
| AD-22132-b1 | 78.5 | 18.5 | 67.5 | 34.1 |
| AD-22133-b1 | 26.4 | 7.1 | 15.0 | 6.7 |
| AD-22134-b1 | 26.9 | 0.1 | 22.4 | 6.5 |
| AD-22169-b1 | 7.3 | 0.6 | 6.0 | 1.5 |
| AD-22169-b1 | 7.0 | 1.1 | 6.1 | 1.3 |
| AD-22170-b1 | 9.3 | 1.6 | 7.2 | 1.8 |
| AD-22170-b1 | 9.7 | 1.1 | 11.2 | 1.0 |
| AD-22171-b1 | 7.1 | 2.3 | 4.5 | 0.2 |
| AD-22171-b1 | 6.5 | 1.9 | 4.4 | 2.8 |
| AD-22172-b1 | 7.2 | 1.1 | 7.6 | 3.7 |
| AD-22172-b1 | 7.0 | 0.4 | 7.0 | 2.4 |
| AD-22173-b1 | 15.7 | 12.5 | 5.9 | 0.1 |
| AD-22174-b1 | 8.9 | 2.7 | 6.4 | 0.9 |
| AD-22175-b1 | 10.7 | 4.3 | 7.9 | 2.4 |
| AD-22176-b1 | 9.6 | 0.8 | 8.4 | 3.1 |
| AD-22177-b1 | 38.9 | 5.9 | 21.4 | 1.2 |
| AD-22178-b1 | 6.5 | 0.5 | 5.6 | 0.9 |
| AD-22179-b1 | 7.0 | 0.8 | 5.9 | 0.1 |
| AD-22180-b1 | 7.3 | 3.7 | 7.2 | 1.6 |
| AD-22181-b1 | 11.1 | 0.9 | 10.0 | 1.0 |
| AD-22182-b1 | 5.4 | 1.4 | 4.0 | 1.5 |
| AD-22183-b1 | 3.8 | 0.4 | 2.9 | 0.4 |
| AD-22184-b1 | 5.1 | 0.2 | 3.7 | 0.7 |
| AD-22185-b1 | 5.7 | 0.6 | 5.0 | 1.5 |
| AD-22186-b1 | 5.3 | 0.3 | 5.7 | 1.0 |
| AD-22187-b1 | 5.3 | 1.2 | 5.3 | 1.4 |

TABLE 9-continued

Single dose treatment of HeLa cells with siRNA flanking AD-9680

| Duplex ID | % message remaining 0.1 nM | SD 0.1 nM | % message remaining 10 nM | SD 10 nM |
|---|---|---|---|---|
| AD-22188-b1 | 12.6 | 2.6 | 11.6 | 0.2 |
| AD-22189-b1 | 5.2 | 0.5 | 4.5 | 1.8 |
| AD-22190-b1 | 4.7 | 1.3 | 3.4 | 1.1 |
| AD-22191-b1 | 10.5 | 0.6 | 7.9 | 0.9 |
| AD-22192-b1 | 6.9 | 2.2 | 5.8 | 3.5 |
| AD-22193-b1 | 7.5 | 1.5 | 5.2 | 0.6 |
| AD-22194-b1 | 8.0 | 1.4 | 6.5 | 1.9 |
| AD-22195-b1 | 7.0 | 1.9 | 4.9 | 2.3 |
| AD-22196-b1 | 5.4 | 0.0 | 3.8 | 0.9 |
| AD-22197-b1 | 6.6 | 0.4 | 5.2 | 1.2 |
| AD-22198-b1 | 7.3 | 0.8 | 8.5 | 2.4 |
| AD-22199-b1 | 5.5 | 0.7 | 4.2 | 1.2 |
| AD-22200-b1 | 11.0 | 0.5 | 12.5 | 3.1 |
| AD-22201-b1 | 44.0 | 3.1 | 47.3 | 8.3 |
| AD-22202-b1 | 9.0 | 1.2 | 7.2 | 0.9 |
| AD-22203-b1 | 12.5 | 0.0 | 12.7 | 2.2 |
| AD-22204-b1 | 57.1 | 5.2 | 50.2 | 10.2 |
| AD-22205-b1 | 27.0 | 0.4 | 24.5 | 0.0 |
| AD-22206-b1 | 13.9 | 1.1 | 11.4 | 1.3 |
| AD-9680 | 7.1 | ND | 9.3 | ND |

TABLE 10

IC50 in HeLa cells using siRNA flanking AD-9680

| Duplex Name | Rep1 IC50 (pM) | Rep2 IC50 (pM) | Average IC50 (pM) |
|---|---|---|---|
| AD-22098 | 6.0 | 6.7 | 6.4 |
| AD-22099 | 25.0 | 37.8 | 31.4 |
| AD-22101 | 66.5 | 81.9 | 74.2 |
| AD-22102 | 2.3 | 1.5 | 1.9 |
| AD-22103 | 6.3 | 1.2 | 3.8 |
| AD-22104 | 2.2 | 1.4 | 1.8 |
| AD-22105 | 13.3 | 0.1 | 6.7 |
| AD-22107 | 2.2 | 0.9 | 1.6 |
| AD-22108 | 2.3 | 2.0 | 2.1 |
| AD-22109 | 5.5 | 6.3 | 5.9 |
| AD-22110 | 59.1 | 42.2 | 50.7 |
| AD-22111 | 9.1 | 8.2 | 8.7 |
| AD-22112 | 25.8 | 31.0 | 28.4 |
| AD-22113 | 4.2 | 4.4 | 4.3 |
| AD-22114 | 6.9 | 4.0 | 5.5 |
| AD-22115 | 3.0 | 2.2 | 2.6 |
| AD-22117 | 56.0 | 37.6 | 46.8 |
| AD-22118 | 2.9 | 1.7 | 2.3 |
| AD-22119 | 6.7 | 0.0 | 3.4 |
| AD-22120 | 2.0 | 1.2 | 1.6 |
| AD-22121 | 2.1 | 4.1 | 3.1 |
| AD-22122 | 203.3 | 156.3 | 179.8 |
| AD-22123 | 33.1 | 50.7 | 41.9 |
| AD-22124 | 18.8 | 13.1 | 15.9 |
| AD-22125 | 3.3 | 2.6 | 3.0 |
| AD-22126 | 17.9 | 18.5 | 18.2 |
| AD-22127 | 11.1 | 4.3 | 7.7 |
| AD-22128 | 14.6 | 3.3 | 8.9 |
| AD-22130 | 1.7 | 0.3 | 1.0 |
| AD-22131 | 172.5 | 59.6 | 116.0 |
| AD-22133 | 94.6 | 57.2 | 75.9 |
| AD-22134 | 113.0 | 81.3 | 97.2 |
| AD-9680 | 3.8 | 2.4 | 3.1 |

SEQUENCE LISTING (1732 sequences)

SEQ ID NO: 1 - DNA, 21 bp, Artificial Sequence
  Description of Artificial Sequence: Synthetic oligonucleotide
  Description of Combined DNA/RNA Molecule: Synthetic oligonucleotide
agcgacgucgaggcgcucatt

SEQ ID NO: 2 - DNA, 21 bp, Artificial Sequence
  Description of Artificial Sequence: Synthetic oligonucleotide
  Description of Combined DNA/RNA Molecule: Synthetic oligonucleotide
ugagcgccucgacgucgcutt

SEQ ID NO: 3 - DNA, 21 bp, Artificial Sequence
  Description of Artificial Sequence: Synthetic oligonucleotide
  Description of Combined DNA/RNA Molecule: Synthetic oligonucleotide
cgcucaugguugcaggcggtt

SEQ ID NO: 4 - DNA, 21 bp, Artificial Sequence
  Description of Artificial Sequence: Synthetic oligonucleotide
  Description of Combined DNA/RNA Molecule: Synthetic oligonucleotide
ccgccugcaaccaugagcgtt

SEQ ID NO: 5 - DNA, 21 bp, Artificial Sequence
  Description of Artificial Sequence: Synthetic oligonucleotide
  Description of Combined DNA/RNA Molecule: Synthetic oligonucleotide
gcucaugguugcaggcgggtt

SEQ ID NO: 6 - DNA, 21 bp, Artificial Sequence
  Description of Artificial Sequence: Synthetic oligonucleotide
  Description of Combined DNA/RNA Molecule: Synthetic oligonucleotide
cccgccugcaaccaugagctt

SEQ ID NO: 7 - DNA, 21 bp, Artificial Sequence
  Description of Artificial Sequence: Synthetic oligonucleotide
  Description of Combined DNA/RNA Molecule: Synthetic oligonucleotide
gcgggcgccgccguucagutt

SEQ ID NO: 8 - DNA, 21 bp, Artificial Sequence
  Description of Artificial Sequence: Synthetic oligonucleotide
  Description of Combined DNA/RNA Molecule: Synthetic oligonucleotide
acugaacggcggcgcccgctt

SEQ ID NO: 9 - DNA, 21 bp, Artificial Sequence
  Description of Artificial Sequence: Synthetic oligonucleotide
  Description of Combined DNA/RNA Molecule: Synthetic oligonucleotide
cgggcgccgccguucaguutt

SEQ ID NO: 10 - DNA, 21 bp, Artificial Sequence
  Description of Artificial Sequence: Synthetic oligonucleotide
  Description of Combined DNA/RNA Molecule: Synthetic oligonucleotide
aacugaacggcggcgcccgtt

SEQ ID NO: 11 - DNA, 21 bp, Artificial Sequence
  Description of Artificial Sequence: Synthetic oligonucleotide
  Description of Combined DNA/RNA Molecule: Synthetic oligonucleotide
gggcgccgccguucaguuctt

SEQ ID NO: 12 - DNA, 21 bp, Artificial Sequence
  Description of Artificial Sequence: Synthetic oligonucleotide
  Description of Combined DNA/RNA Molecule: Synthetic oligonucleotide
gaacugaacggcggcgccctt

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
ccguucaguucagggucugtt

SEQ ID NO: 14 - DNA, 21 bp, Artificial Sequence
  Description of Artificial Sequence: Synthetic oligonucleotide
  Description of Combined DNA/RNA Molecule: Synthetic oligonucleotide
cagacccugaacugaacggtt

SEQ ID NO: 15 - DNA, 21 bp, Artificial Sequence
  Description of Artificial Sequence: Synthetic oligonucleotide
  Description of Combined DNA/RNA Molecule: Synthetic oligonucleotide
uucaguucagggucugagctt

SEQ ID NO: 16 - DNA, 21 bp, Artificial Sequence
  Description of Artificial Sequence: Synthetic oligonucleotide
  Description of Combined DNA/RNA Molecule: Synthetic oligonucleotide
gcucagacccugaacugaatt

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
gugagacuggcucgggcggtt

SEQ ID NO: 18 - DNA, 21 bp, Artificial Sequence
  Description of Artificial Sequence: Synthetic oligonucleotide
  Description of Combined DNA/RNA Molecule: Synthetic oligonucleotide
ccgcccgagccagucucactt

SEQ ID NO: 19 - DNA, 21 bp, Artificial Sequence
  Description of Artificial Sequence: Synthetic oligonucleotide
  Description of Combined DNA/RNA Molecule: Synthetic oligonucleotide
ggccgggacgcgucguugctt

SEQ ID NO: 20 - DNA, 21 bp, Artificial Sequence
  Description of Artificial Sequence: Synthetic oligonucleotide
  Description of Combined DNA/RNA Molecule: Synthetic oligonucleotide
gcaacgacgcgucccggcctt

SEQ ID NO: 21 - DNA, 21 bp, Artificial Sequence
  Description of Artificial Sequence: Synthetic oligonucleotide
  Description of Combined DNA/RNA Molecule: Synthetic oligonucleotide
gccgggacgcgucguugcatt

SEQ ID NO: 22 - DNA, 21 bp, Artificial Sequence
  Description of Artificial Sequence: Synthetic oligonucleotide
  Description of Combined DNA/RNA Molecule: Synthetic oligonucleotide
ugcaacgacgcgucccggctt

SEQ ID NO: 23 - DNA, 21 bp, Artificial Sequence
  Description of Artificial Sequence: Synthetic oligonucleotide
  Description of Combined DNA/RNA Molecule: Synthetic oligonucleotide
ccgggacgcgucguugcagtt

SEQ ID NO: 24 - DNA, 21 bp, Artificial Sequence
  Description of Artificial Sequence: Synthetic oligonucleotide
  Description of Combined DNA/RNA Molecule: Synthetic oligonucleotide
cugcaacgacgcgucccggtt

SEQ ID NO: 25 - DNA, 21 bp, Artificial Sequence
  Description of Artificial Sequence: Synthetic oligonucleotide
  Description of Combined DNA/RNA Molecule: Synthetic oligonucleotide
ggacgcgucguugcagcagtt

SEQ ID NO: 26 - DNA, 21 bp, Artificial Sequence
  Description of Artificial Sequence: Synthetic oligonucleotide
  Description of Combined DNA/RNA Molecule: Synthetic oligonucleotide
cugcugcaacgacgcgucctt

SEQ ID NO: 27 - DNA, 21 bp, Artificial Sequence
  Description of Artificial Sequence: Synthetic oligonucleotide
  Description of Combined DNA/RNA Molecule: Synthetic oligonucleotide
ucccagccaggauuccgcgtt

SEQ ID NO: 28 - DNA, 21 bp, Artificial Sequence
  Description of Artificial Sequence: Synthetic oligonucleotide
  Description of Combined DNA/RNA Molecule: Synthetic oligonucleotide
cgcggaauccuggcugggatt

SEQ ID NO: 29 - DNA, 21 bp, Artificial Sequence
  Description of Artificial Sequence: Synthetic oligonucleotide
  Description of Combined DNA/RNA Molecule: Synthetic oligonucleotide
ucccagccaggauuccgcgtt

SEQ ID NO: 30 - DNA, 21 bp, Artificial Sequence
  Description of Artificial Sequence: Synthetic oligonucleotide
  Description of Combined DNA/RNA Molecule: Synthetic oligonucleotide
cgcggaauccuggcugggatt

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
cccagccaggauuccgcgctt

SEQ ID NO: 32 - DNA, 21 bp, Artificial Sequence
  Description of Artificial Sequence: Synthetic oligonucleotide
  Description of Combined DNA/RNA Molecule: Synthetic oligonucleotide
gcgcggaauccuggcugggtt

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
cccagccaggauuccgcgctt

SEQ ID NO: 34 - DNA, 21 bp, Artificial Sequence
  Description of Artificial Sequence: Synthetic oligonucleotide
  Description of Combined DNA/RNA Molecule: Synthetic oligonucleotide
gcgcggaauccuggcugggtt

SEQ ID NO: 35 - DNA, 21 bp, Artificial Sequence
  Description of Artificial Sequence: Synthetic oligonucleotide
  Description of Combined DNA/RNA Molecule: Synthetic oligonucleotide
cagccaggauuccgcgcgctt

SEQ ID NO: 36 - DNA, 21 bp, Artificial Sequence
  Description of Artificial Sequence: Synthetic oligonucleotide
  Description of Combined DNA/RNA Molecule: Synthetic oligonucleotide
gcgcgcggaauccuggcugtt

SEQ ID NO: 37 - DNA, 21 bp, Artificial Sequence
  Description of Artificial Sequence: Synthetic oligonucleotide
  Description of Combined DNA/RNA Molecule: Synthetic oligonucleotide
cagccaggauuccgcgcgctt

SEQ ID NO: 38 - DNA, 21 bp, Artificial Sequence
  Description of Artificial Sequence: Synthetic oligonucleotide
  Description of Combined DNA/RNA Molecule: Synthetic oligonucleotide
gcgcgcggaauccuggcugtt

SEQ ID NO: 39 - DNA, 21 bp, Artificial Sequence
  Description of Artificial Sequence: Synthetic oligonucleotide
  Description of Combined DNA/RNA Molecule: Synthetic oligonucleotide
agcuccugcacaguccucctt

SEQ ID NO: 40 - DNA, 21 bp, Artificial Sequence
  Description of Artificial Sequence: Synthetic oligonucleotide
  Description of Combined DNA/RNA Molecule: Synthetic oligonucleotide
ggaggacugugcaggagcutt

SEQ ID NO: 41 - DNA, 21 bp, Artificial Sequence
  Description of Artificial Sequence: Synthetic oligonucleotide
  Description of Combined DNA/RNA Molecule: Synthetic oligonucleotide
agcuccugcacaguccucctt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
ggaggacugugcaggagcutt

SEQ ID NO: 43 - DNA, 21 bp, Artificial Sequence
  Description of Artificial Sequence: Synthetic oligonucleotide
  Description of Combined DNA/RNA Molecule: Synthetic oligonucleotide
caccgcaaggcucaaggcgtt

SEQ ID NO: 44 - DNA, 21 bp, Artificial Sequence
  Description of Artificial Sequence: Synthetic oligonucleotide
  Description of Combined DNA/RNA Molecule: Synthetic oligonucleotide
cgccuugagccuugcggugtt

SEQ ID NO: 45 - DNA, 21 bp, Artificial Sequence
  Description of Artificial Sequence: Synthetic oligonucleotide
  Description of Combined DNA/RNA Molecule: Synthetic oligonucleotide
cgcaaggcucaaggcgccgtt

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
cggcgccuugagccuugcgtt

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
caaggcucaaggcgccgcctt

SEQ ID NO: 48 - DNA, 21 bp, Artificial Sequence
  Description of Artificial Sequence: Synthetic oligonucleotide
  Description of Combined DNA/RNA Molecule: Synthetic oligonucleotide
ggcggcgccuugagccuugtt

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
guggaccgcgcacggccuctt

SEQ ID NO: 50 - DNA, 21 bp, Artificial Sequence
  Description of Artificial Sequence: Synthetic oligonucleotide
  Description of Combined DNA/RNA Molecule: Synthetic oligonucleotide
gaggccgugcgcgguccactt

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
uggaccgcgcacggccucutt

SEQ ID NO: 52 - DNA, 21 bp, Artificial Sequence
  Description of Artificial Sequence: Synthetic oligonucleotide
  Description of Combined DNA/RNA Molecule: Synthetic oligonucleotide
agaggccgugcgcgguccatt

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
ggaccgcgcacggccucuatt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
uagaggccgugcgcggucctt

SEQ ID NO: 55 - DNA, 21 bp, Artificial Sequence
  Description of Artificial Sequence: Synthetic oligonucleotide
  Description of Combined DNA/RNA Molecule: Synthetic oligonucleotide
gaccgcgcacggccucuagtt

SEQ ID NO: 56 - DNA, 21 bp, Artificial Sequence
  Description of Artificial Sequence: Synthetic oligonucleotide
  Description of Combined DNA/RNA Molecule: Synthetic oligonucleotide
cuagaggccgugcgcgguctt

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
accgcgcacggccucuaggtt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
ccuagaggccgugcgcggutt

SEQ ID NO: 59 - DNA, 21 bp, Artificial Sequence
  Description of Artificial Sequence: Synthetic oligonucleotide
  Description of Combined DNA/RNA Molecule: Synthetic oligonucleotide
ccgcgcacggccucuaggutt

SEQ ID NO: 60 - DNA, 21 bp, Artificial Sequence
  Description of Artificial Sequence: Synthetic oligonucleotide
  Description of Combined DNA/RNA Molecule: Synthetic oligonucleotide
accuagaggccgugcgcggtt

SEQ ID NO: 61 - DNA, 21 bp, Artificial Sequence
  Description of Artificial Sequence: Synthetic oligonucleotide
  Description of Combined DNA/RNA Molecule: Synthetic oligonucleotide
cgcgcacggccucuagguctt

SEQ ID NO: 62 - DNA, 21 bp, Artificial Sequence
  Description of Artificial Sequence: Synthetic oligonucleotide
  Description of Combined DNA/RNA Molecule: Synthetic oligonucleotide
gaccuagaggccgugcgcgtt

SEQ ID NO: 63 - DNA, 21 bp, Artificial Sequence
  Description of Artificial Sequence: Synthetic oligonucleotide
  Description of Combined DNA/RNA Molecule: Synthetic oligonucleotide
gcgcacggccucuaggucutt

SEQ ID NO: 64 - DNA, 21 bp, Artificial Sequence
  Description of Artificial Sequence: Synthetic oligonucleotide
  Description of Combined DNA/RNA Molecule: Synthetic oligonucleotide
agaccuagaggccgugcgctt

SEQ ID NO: 65 - DNA, 21 bp, Artificial Sequence
  Description of Artificial Sequence: Synthetic oligonucleotide
  Description of Combined DNA/RNA Molecule: Synthetic oligonucleotide
cgcacggccucuaggucuctt

SEQ ID NO: 66 - DNA, 21 bp, Artificial Sequence
  Description of Artificial Sequence: Synthetic oligonucleotide
  Description of Combined DNA/RNA Molecule: Synthetic oligonucleotide
gagaccuagaggccgugcgtt

SEQ ID NO: 67 - DNA, 21 bp, Artificial Sequence
  Description of Artificial Sequence: Synthetic oligonucleotide
  Description of Combined DNA/RNA Molecule: Synthetic oligonucleotide
cucuaggucuccucgccagtt

SEQ ID NO: 68 - DNA, 21 bp, Artificial Sequence
  Description of Artificial Sequence: Synthetic oligonucleotide
  Description of Combined DNA/RNA Molecule: Synthetic oligonucleotide
cuggcgaggagaccuagagtt

SEQ ID NO: 69 - DNA, 21 bp, Artificial Sequence
  Description of Artificial Sequence: Synthetic oligonucleotide
  Description of Combined DNA/RNA Molecule: Synthetic oligonucleotide
ucuaggucuccucgccaggtt

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
ccuggcgaggagaccuagatt

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
cuaggucuccucgccaggatt

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
uccuggcgaggagaccuagtt

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
aggucuccucgccaggacatt

SEQ ID NO: 74 - DNA, 21 bp, Artificial Sequence
  Description of Artificial Sequence: Synthetic oligonucleotide
  Description of Combined DNA/RNA Molecule: Synthetic oligonucleotide
uguccuggcgaggagaccutt

SEQ ID NO: 75 - DNA, 21 bp, Artificial Sequence
  Description of Artificial Sequence: Synthetic oligonucleotide
  Description of Combined DNA/RNA Molecule: Synthetic oligonucleotide
ccucgccaggacagcaacctt

SEQ ID NO: 76 - DNA, 21 bp, Artificial Sequence
  Description of Artificial Sequence: Synthetic oligonucleotide
  Description of Combined DNA/RNA Molecule: Synthetic oligonucleotide
gguugcuguccuggcgaggtt

SEQ ID NO: 77 - DNA, 21 bp, Artificial Sequence
  Description of Artificial Sequence: Synthetic oligonucleotide
  Description of Combined DNA/RNA Molecule: Synthetic oligonucleotide
cgucagcuccaggcggucctt

SEQ ID NO: 78 - DNA, 21 bp, Artificial Sequence
  Description of Artificial Sequence: Synthetic oligonucleotide
  Description of Combined DNA/RNA Molecule: Synthetic oligonucleotide
ggaccgccuggagcugacgtt

SEQ ID NO: 79 - DNA, 21 bp, Artificial Sequence
  Description of Artificial Sequence: Synthetic oligonucleotide
  Description of Combined DNA/RNA Molecule: Synthetic oligonucleotide
cgucagcuccaggcggucctt

SEQ ID NO: 80 - DNA, 21 bp, Artificial Sequence
  Description of Artificial Sequence: Synthetic oligonucleotide
  Description of Combined DNA/RNA Molecule: Synthetic oligonucleotide
ggaccgccuggagcugacgtt

SEQ ID NO: 81 - DNA, 21 bp, Artificial Sequence
  Description of Artificial Sequence: Synthetic oligonucleotide
  Description of Combined DNA/RNA Molecule: Synthetic oligonucleotide
gucagcuccaggcgguccutt

SEQ ID NO: 82 - DNA, 21 bp, Artificial Sequence
  Description of Artificial Sequence: Synthetic oligonucleotide
  Description of Combined DNA/RNA Molecule: Synthetic oligonucleotide
aggaccgccuggagcugactt

SEQ ID NO: 83 - DNA, 21 bp, Artificial Sequence
  Description of Artificial Sequence: Synthetic oligonucleotide
  Description of Combined DNA/RNA Molecule: Synthetic oligonucleotide
gucagcuccaggcgguccutt

SEQ ID NO: 84 - DNA, 21 bp, Artificial Sequence
  Description of Artificial Sequence: Synthetic oligonucleotide
  Description of Combined DNA/RNA Molecule: Synthetic oligonucleotide
aggaccgccuggagcugactt

SEQ ID NO: 85 - DNA, 21 bp, Artificial Sequence
  Description of Artificial Sequence: Synthetic oligonucleotide
  Description of Combined DNA/RNA Molecule: Synthetic oligonucleotide
ggcgcccgugcgcaggaggtt

SEQ ID NO: 86 - DNA, 21 bp, Artificial Sequence
  Description of Artificial Sequence: Synthetic oligonucleotide
  Description of Combined DNA/RNA Molecule: Synthetic oligonucleotide
ccuccugcgcacgggcgcctt

SEQ ID NO: 87 - DNA, 21 bp, Artificial Sequence
  Description of Artificial Sequence: Synthetic oligonucleotide
  Description of Combined DNA/RNA Molecule: Synthetic oligonucleotide
ggagcuggugcuagccuugtt

SEQ ID NO: 88 - DNA, 21 bp, Artificial Sequence
  Description of Artificial Sequence: Synthetic oligonucleotide
  Description of Combined DNA/RNA Molecule: Synthetic oligonucleotide
caaggcuagcaccagcucctt

SEQ ID NO: 89 - DNA, 21 bp, Artificial Sequence
  Description of Artificial Sequence: Synthetic oligonucleotide
  Description of Combined DNA/RNA Molecule: Synthetic oligonucleotide
ggagcuggugcuagccuugtt

SEQ ID NO: 90 - DNA, 21 bp, Artificial Sequence
  Description of Artificial Sequence: Synthetic oligonucleotide
  Description of Combined DNA/RNA Molecule: Synthetic oligonucleotide
caaggcuagcaccagcucctt

SEQ ID NO: 91 - DNA, 21 bp, Artificial Sequence
  Description of Artificial Sequence: Synthetic oligonucleotide
  Description of Combined DNA/RNA Molecule: Synthetic oligonucleotide
gcuggugcuagccuugcgutt

SEQ ID NO: 92 - DNA, 21 bp, Artificial Sequence
  Description of Artificial Sequence: Synthetic oligonucleotide
  Description of Combined DNA/RNA Molecule: Synthetic oligonucleotide
acgcaaggcuagcaccagctt

SEQ ID NO: 93 - DNA, 21 bp, Artificial Sequence
  Description of Artificial Sequence: Synthetic oligonucleotide
  Description of Combined DNA/RNA Molecule: Synthetic oligonucleotide
gcuggugcuagccuugcgutt

SEQ ID NO: 94 - DNA, 21 bp, Artificial Sequence
  Description of Artificial Sequence: Synthetic oligonucleotide
  Description of Combined DNA/RNA Molecule: Synthetic oligonucleotide
acgcaaggcuagcaccagctt

SEQ ID NO: 95 - DNA, 21 bp, Artificial Sequence
  Description of Artificial Sequence: Synthetic oligonucleotide
  Description of Combined DNA/RNA Molecule: Synthetic oligonucleotide
cuggugcuagccuugcguutt

SEQ ID NO: 96 - DNA, 21 bp, Artificial Sequence
  Description of Artificial Sequence: Synthetic oligonucleotide
  Description of Combined DNA/RNA Molecule: Synthetic oligonucleotide
aacgcaaggcuagcaccagtt

SEQ ID NO: 97 - DNA, 21 bp, Artificial Sequence
  Description of Artificial Sequence: Synthetic oligonucleotide
  Description of Combined DNA/RNA Molecule: Synthetic oligonucleotide
cuggugcuagccuugcguutt

SEQ ID NO: 98 - DNA, 21 bp, Artificial Sequence
  Description of Artificial Sequence: Synthetic oligonucleotide
  Description of Combined DNA/RNA Molecule: Synthetic oligonucleotide
aacgcaaggcuagcaccagtt

SEQ ID NO: 99 - DNA, 21 bp, Artificial Sequence
  Description of Artificial Sequence: Synthetic oligonucleotide
  Description of Combined DNA/RNA Molecule: Synthetic oligonucleotide
cuggugcuagccuugcguutt

SEQ ID NO: 100 - DNA, 21 bp, Artificial Sequence
  Description of Artificial Sequence: Synthetic oligonucleotide
  Description of Combined DNA/RNA Molecule: Synthetic oligonucleotide
aacgcaaggcuagcaccagtt

SEQ ID NO: 101 - DNA, 21 bp, Artificial Sequence
  Description of Artificial Sequence: Synthetic oligonucleotide
  Description of Combined DNA/RNA Molecule: Synthetic oligonucleotide
ugcuagccuugcguuccgatt

SEQ ID NO: 102 - DNA, 21 bp, Artificial Sequence
  Description of Artificial Sequence: Synthetic oligonucleotide
  Description of Combined DNA/RNA Molecule: Synthetic oligonucleotide
ucggaacgcaaggcuagcatt

SEQ ID NO: 103 - DNA, 21 bp, Artificial Sequence
  Description of Artificial Sequence: Synthetic oligonucleotide
  Description of Combined DNA/RNA Molecule: Synthetic oligonucleotide
ugcuagccuugcguuccgatt

SEQ ID NO: 104 - DNA, 21 bp, Artificial Sequence
  Description of Artificial Sequence: Synthetic oligonucleotide
  Description of Combined DNA/RNA Molecule: Synthetic oligonucleotide
ucggaacgcaaggcuagcatt

SEQ ID NO: 105 - DNA, 21 bp, Artificial Sequence
  Description of Artificial Sequence: Synthetic oligonucleotide
  Description of Combined DNA/RNA Molecule: Synthetic oligonucleotide
uagccuugcguuccgaggatt

SEQ ID NO: 106 - DNA, 21 bp, Artificial Sequence
  Description of Artificial Sequence: Synthetic oligonucleotide
  Description of Combined DNA/RNA Molecule: Synthetic oligonucleotide
uccucggaacgcaaggcuatt

SEQ ID NO: 107 - DNA, 21 bp, Artificial Sequence
  Description of Artificial Sequence: Synthetic oligonucleotide
  Description of Combined DNA/RNA Molecule: Synthetic oligonucleotide
uagccuugcguuccgaggatt

SEQ ID NO: 108 - DNA, 21 bp, Artificial Sequence
  Description of Artificial Sequence: Synthetic oligonucleotide
  Description of Combined DNA/RNA Molecule: Synthetic oligonucleotide
uccucggaacgcaaggcuatt

SEQ ID NO: 109 - DNA, 21 bp, Artificial Sequence
  Description of Artificial Sequence: Synthetic oligonucleotide
  Description of Combined DNA/RNA Molecule: Synthetic oligonucleotide
gacggccuggccgaagcactt

SEQ ID NO: 110 - DNA, 21 bp, Artificial Sequence
  Description of Artificial Sequence: Synthetic oligonucleotide
  Description of Combined DNA/RNA Molecule: Synthetic oligonucleotide
gugcuucggccaggccguctt

SEQ ID NO: 111 - DNA, 21 bp, Artificial Sequence
  Description of Artificial Sequence: Synthetic oligonucleotide
  Description of Combined DNA/RNA Molecule: Synthetic oligonucleotide
ggccgaagcacccgagcactt

SEQ ID NO: 112 - DNA, 21 bp, Artificial Sequence
  Description of Artificial Sequence: Synthetic oligonucleotide
  Description of Combined DNA/RNA Molecule: Synthetic oligonucleotide
gugcucgggugcuucggcctt

SEQ ID NO: 113 - DNA, 21 bp, Artificial Sequence
  Description of Artificial Sequence: Synthetic oligonucleotide
  Description of Combined DNA/RNA Molecule: Synthetic oligonucleotide
gccgaagcacccgagcacgtt

SEQ ID NO: 114 - DNA, 21 bp, Artificial Sequence
  Description of Artificial Sequence: Synthetic oligonucleotide
  Description of Combined DNA/RNA Molecule: Synthetic oligonucleotide
cgugcucgggugcuucggctt

SEQ ID NO: 115 - DNA, 21 bp, Artificial Sequence
  Description of Artificial Sequence: Synthetic oligonucleotide
  Description of Combined DNA/RNA Molecule: Synthetic oligonucleotide
ccgaagcacccgagcacggtt

SEQ ID NO: 116 - DNA, 21 bp, Artificial Sequence
  Description of Artificial Sequence: Synthetic oligonucleotide
  Description of Combined DNA/RNA Molecule: Synthetic oligonucleotide
ccgugcucgggugcuucggtt

SEQ ID NO: 117 - DNA, 21 bp, Artificial Sequence
  Description of Artificial Sequence: Synthetic oligonucleotide
  Description of Combined DNA/RNA Molecule: Synthetic oligonucleotide
ccgagcacggaaccacagctt

SEQ ID NO: 118 - DNA, 21 bp, Artificial Sequence
  Description of Artificial Sequence: Synthetic oligonucleotide
  Description of Combined DNA/RNA Molecule: Synthetic oligonucleotide
gcugugguuccgugcucggtt

SEQ ID NO: 119 - DNA, 21 bp, Artificial Sequence
  Description of Artificial Sequence: Synthetic oligonucleotide
  Description of Combined DNA/RNA Molecule: Synthetic oligonucleotide
caccgcugcgccaaggauctt

SEQ ID NO: 120 - DNA, 21 bp, Artificial Sequence
  Description of Artificial Sequence: Synthetic oligonucleotide
  Description of Combined DNA/RNA Molecule: Synthetic oligonucleotide
gauccuuggcgcagcggugtt

SEQ ID NO: 121 - DNA, 21 bp, Artificial Sequence
  Description of Artificial Sequence: Synthetic oligonucleotide
  Description of Combined DNA/RNA Molecule: Synthetic oligonucleotide
ccgcugcgccaaggauccgtt

SEQ ID NO: 122 - DNA, 21 bp, Artificial Sequence
  Description of Artificial Sequence: Synthetic oligonucleotide
  Description of Combined DNA/RNA Molecule: Synthetic oligonucleotide
cggauccuuggcgcagcggtt

SEQ ID NO: 123 - DNA, 21 bp, Artificial Sequence
  Description of Artificial Sequence: Synthetic oligonucleotide
  Description of Combined DNA/RNA Molecule: Synthetic oligonucleotide
cgcugcgccaaggauccgutt

SEQ ID NO: 124 - DNA, 21 bp, Artificial Sequence
  Description of Artificial Sequence: Synthetic oligonucleotide
  Description of Combined DNA/RNA Molecule: Synthetic oligonucleotide
acggauccuuggcgcagcgtt

SEQ ID NO: 125 - DNA, 21 bp, Artificial Sequence
  Description of Artificial Sequence: Synthetic oligonucleotide
  Description of Combined DNA/RNA Molecule: Synthetic oligonucleotide
cugcgccaaggauccguggtt

SEQ ID NO: 126 - DNA, 21 bp, Artificial Sequence
  Description of Artificial Sequence: Synthetic oligonucleotide
  Description of Combined DNA/RNA Molecule: Synthetic oligonucleotide
ccacggauccuuggcgcagtt

SEQ ID NO: 127 - DNA, 21 bp, Artificial Sequence
  Description of Artificial Sequence: Synthetic oligonucleotide
  Description of Combined DNA/RNA Molecule: Synthetic oligonucleotide
auccguggagguugccuggtt

SEQ ID NO: 128 - DNA, 21 bp, Artificial Sequence
  Description of Artificial Sequence: Synthetic oligonucleotide
  Description of Combined DNA/RNA Molecule: Synthetic oligonucleotide
ccaggcaaccuccacggautt

SEQ ID NO: 129 - DNA, 21 bp, Artificial Sequence
  Description of Artificial Sequence: Synthetic oligonucleotide
  Description of Combined DNA/RNA Molecule: Synthetic oligonucleotide
gguugccuggcaccuacgutt

SEQ ID NO: 130 - DNA, 21 bp, Artificial Sequence
  Description of Artificial Sequence: Synthetic oligonucleotide
  Description of Combined DNA/RNA Molecule: Synthetic oligonucleotide
acguaggugccaggcaacctt

SEQ ID NO: 131 - DNA, 21 bp, Artificial Sequence
  Description of Artificial Sequence: Synthetic oligonucleotide
  Description of Combined DNA/RNA Molecule: Synthetic oligonucleotide
aggagacccaccucucgcatt

SEQ ID NO: 132 - DNA, 21 bp, Artificial Sequence
  Description of Artificial Sequence: Synthetic oligonucleotide
  Description of Combined DNA/RNA Molecule: Synthetic oligonucleotide
ugcgagaggugggucuccutt

SEQ ID NO: 133 - DNA, 21 bp, Artificial Sequence
  Description of Artificial Sequence: Synthetic oligonucleotide
  Description of Combined DNA/RNA Molecule: Synthetic oligonucleotide
ggagacccaccucucgcagtt

SEQ ID NO: 134 - DNA, 21 bp, Artificial Sequence
  Description of Artificial Sequence: Synthetic oligonucleotide
  Description of Combined DNA/RNA Molecule: Synthetic oligonucleotide
cugcgagaggugggucucctt

SEQ ID NO: 135 - DNA, 21 bp, Artificial Sequence
  Description of Artificial Sequence: Synthetic oligonucleotide
  Description of Combined DNA/RNA Molecule: Synthetic oligonucleotide
gagacccaccucucgcagutt

SEQ ID NO: 136 - DNA, 21 bp, Artificial Sequence
  Description of Artificial Sequence: Synthetic oligonucleotide
  Description of Combined DNA/RNA Molecule: Synthetic oligonucleotide
acugcgagaggugggucuctt

SEQ ID NO: 137 - DNA, 21 bp, Artificial Sequence
  Description of Artificial Sequence: Synthetic oligonucleotide
  Description of Combined DNA/RNA Molecule: Synthetic oligonucleotide
ccaccucucgcagucagagtt

SEQ ID NO: 138 - DNA, 21 bp, Artificial Sequence
  Description of Artificial Sequence: Synthetic oligonucleotide
  Description of Combined DNA/RNA Molecule: Synthetic oligonucleotide
cucugacugcgagagguggtt

SEQ ID NO: 139 - DNA, 21 bp, Artificial Sequence
  Description of Artificial Sequence: Synthetic oligonucleotide
  Description of Combined DNA/RNA Molecule: Synthetic oligonucleotide
ccucucgcagucagagcgctt

SEQ ID NO: 140 - DNA, 21 bp, Artificial Sequence
  Description of Artificial Sequence: Synthetic oligonucleotide
  Description of Combined DNA/RNA Molecule: Synthetic oligonucleotide
gcgcucugacugcgagaggtt

SEQ ID NO: 141 - DNA, 21 bp, Artificial Sequence
  Description of Artificial Sequence: Synthetic oligonucleotide
  Description of Combined DNA/RNA Molecule: Synthetic oligonucleotide
cucucgcagucagagcgcatt

SEQ ID NO: 142 - DNA, 21 bp, Artificial Sequence
  Description of Artificial Sequence: Synthetic oligonucleotide
  Description of Combined DNA/RNA Molecule: Synthetic oligonucleotide
ugcgcucugacugcgagagtt

SEQ ID NO: 143 - DNA, 21 bp, Artificial Sequence
  Description of Artificial Sequence: Synthetic oligonucleotide
  Description of Combined DNA/RNA Molecule: Synthetic oligonucleotide
ucucgcagucagagcgcactt

SEQ ID NO: 144 - DNA, 21 bp, Artificial Sequence
  Description of Artificial Sequence: Synthetic oligonucleotide
  Description of Combined DNA/RNA Molecule: Synthetic oligonucleotide
gugcgcucugacugcgagatt

SEQ ID NO: 145 - DNA, 21 bp, Artificial Sequence
  Description of Artificial Sequence: Synthetic oligonucleotide
  Description of Combined DNA/RNA Molecule: Synthetic oligonucleotide
cucgcagucagagcgcacutt

SEQ ID NO: 146 - DNA, 21 bp, Artificial Sequence
  Description of Artificial Sequence: Synthetic oligonucleotide
  Description of Combined DNA/RNA Molecule: Synthetic oligonucleotide
agugcgcucugacugcgagtt

SEQ ID NO: 147 - DNA, 21 bp, Artificial Sequence
  Description of Artificial Sequence: Synthetic oligonucleotide
  Description of Combined DNA/RNA Molecule: Synthetic oligonucleotide
cucgcagucagagcgcacutt

SEQ ID NO: 148 - DNA, 21 bp, Artificial Sequence
  Description of Artificial Sequence: Synthetic oligonucleotide
  Description of Combined DNA/RNA Molecule: Synthetic oligonucleotide
agugcgcucugacugcgagtt

SEQ ID NO: 149 - DNA, 21 bp, Artificial Sequence
  Description of Artificial Sequence: Synthetic oligonucleotide
  Description of Combined DNA/RNA Molecule: Synthetic oligonucleotide
gcagucagagcgcacugcctt

SEQ ID NO: 150 - DNA, 21 bp, Artificial Sequence
  Description of Artificial Sequence: Synthetic oligonucleotide
  Description of Combined DNA/RNA Molecule: Synthetic oligonucleotide
ggcagugcgcucugacugctt

SEQ ID NO: 151 - DNA, 21 bp, Artificial Sequence
  Description of Artificial Sequence: Synthetic oligonucleotide
  Description of Combined DNA/RNA Molecule: Synthetic oligonucleotide
gcagucagagcgcacugcctt

SEQ ID NO: 152 - DNA, 21 bp, Artificial Sequence
  Description of Artificial Sequence: Synthetic oligonucleotide
  Description of Combined DNA/RNA Molecule: Synthetic oligonucleotide
ggcagugcgcucugacugctt

SEQ ID NO: 153 - DNA, 21 bp, Artificial Sequence
  Description of Artificial Sequence: Synthetic oligonucleotide
  Description of Combined DNA/RNA Molecule: Synthetic oligonucleotide
gggauaccucaccaagauctt

SEQ ID NO: 154 - DNA, 21 bp, Artificial Sequence
  Description of Artificial Sequence: Synthetic oligonucleotide
  Description of Combined DNA/RNA Molecule: Synthetic oligonucleotide
gaucuuggugagguauccctt

SEQ ID NO: 155 - DNA, 21 bp, Artificial Sequence
  Description of Artificial Sequence: Synthetic oligonucleotide
  Description of Combined DNA/RNA Molecule: Synthetic oligonucleotide
gggauaccucaccaagauctt

SEQ ID NO: 156 - DNA, 21 bp, Artificial Sequence
  Description of Artificial Sequence: Synthetic oligonucleotide
  Description of Combined DNA/RNA Molecule: Synthetic oligonucleotide
gaucuuggugagguauccctt

SEQ ID NO: 157 - DNA, 21 bp, Artificial Sequence
  Description of Artificial Sequence: Synthetic oligonucleotide
  Description of Combined DNA/RNA Molecule: Synthetic oligonucleotide
uggugaagaugaguggcgatt

SEQ ID NO: 158 - DNA, 21 bp, Artificial Sequence
  Description of Artificial Sequence: Synthetic oligonucleotide
  Description of Combined DNA/RNA Molecule: Synthetic oligonucleotide
ucgccacucaucuucaccatt

SEQ ID NO: 159 - DNA, 21 bp, Artificial Sequence
  Description of Artificial Sequence: Synthetic oligonucleotide
  Description of Combined DNA/RNA Molecule: Synthetic oligonucleotide
uggugaagaugaguggcgatt

SEQ ID NO: 160 - DNA, 21 bp, Artificial Sequence
  Description of Artificial Sequence: Synthetic oligonucleotide
  Description of Combined DNA/RNA Molecule: Synthetic oligonucleotide
ucgccacucaucuucaccatt

SEQ ID NO: 161 - DNA, 21 bp, Artificial Sequence
  Description of Artificial Sequence: Synthetic oligonucleotide
  Description of Combined DNA/RNA Molecule: Synthetic oligonucleotide
gaagaugaguggcgaccugtt

SEQ ID NO: 162 - DNA, 21 bp, Artificial Sequence
  Description of Artificial Sequence: Synthetic oligonucleotide
  Description of Combined DNA/RNA Molecule: Synthetic oligonucleotide
caggucgccacucaucuuctt

SEQ ID NO: 163 - DNA, 21 bp, Artificial Sequence
  Description of Artificial Sequence: Synthetic oligonucleotide
  Description of Combined DNA/RNA Molecule: Synthetic oligonucleotide
gaagaugaguggcgaccugtt

SEQ ID NO: 164 - DNA, 21 bp, Artificial Sequence
  Description of Artificial Sequence: Synthetic oligonucleotide
  Description of Combined DNA/RNA Molecule: Synthetic oligonucleotide
caggucgccacucaucuuctt

SEQ ID NO: 165 - DNA, 21 bp, Artificial Sequence
  Description of Artificial Sequence: Synthetic oligonucleotide
  Description of Combined DNA/RNA Molecule: Synthetic oligonucleotide
cccaugucgacuacaucgatt

SEQ ID NO: 166 - DNA, 21 bp, Artificial Sequence
  Description of Artificial Sequence: Synthetic oligonucleotide
  Description of Combined DNA/RNA Molecule: Synthetic oligonucleotide
ucgauguagucgacaugggtt

SEQ ID NO: 167 - DNA, 21 bp, Artificial Sequence
  Description of Artificial Sequence: Synthetic oligonucleotide
  Description of Combined DNA/RNA Molecule: Synthetic oligonucleotide
cccaugucgacuacaucgatt

SEQ ID NO: 168 - DNA, 21 bp, Artificial Sequence
  Description of Artificial Sequence: Synthetic oligonucleotide
  Description of Combined DNA/RNA Molecule: Synthetic oligonucleotide
ucgauguagucgacaugggtt

SEQ ID NO: 169 - DNA, 21 bp, Artificial Sequence
  Description of Artificial Sequence: Synthetic oligonucleotide
  Description of Combined DNA/RNA Molecule: Synthetic oligonucleotide
aucgaggaggacuccucugtt

SEQ ID NO: 170 - DNA, 21 bp, Artificial Sequence
  Description of Artificial Sequence: Synthetic oligonucleotide
  Description of Combined DNA/RNA Molecule: Synthetic oligonucleotide
cagaggaguccuccucgautt

SEQ ID NO: 171 - DNA, 21 bp, Artificial Sequence
  Description of Artificial Sequence: Synthetic oligonucleotide
  Description of Combined DNA/RNA Molecule: Synthetic oligonucleotide
aucgaggaggacuccucugtt

SEQ ID NO: 172 - DNA, 21 bp, Artificial Sequence
  Description of Artificial Sequence: Synthetic oligonucleotide
  Description of Combined DNA/RNA Molecule: Synthetic oligonucleotide
cagaggaguccuccucgautt

SEQ ID NO: 173 - DNA, 21 bp, Artificial Sequence
  Description of Artificial Sequence: Synthetic oligonucleotide
  Description of Combined DNA/RNA Molecule: Synthetic oligonucleotide
ggaaccuggagcggauuactt

SEQ ID NO: 174 - DNA, 21 bp, Artificial Sequence
  Description of Artificial Sequence: Synthetic oligonucleotide
  Description of Combined DNA/RNA Molecule: Synthetic oligonucleotide
guaauccgcuccagguucctt

SEQ ID NO: 175 - DNA, 21 bp, Artificial Sequence
  Description of Artificial Sequence: Synthetic oligonucleotide
  Description of Combined DNA/RNA Molecule: Synthetic oligonucleotide
gaaccuggagcggauuacctt

SEQ ID NO: 176 - DNA, 21 bp, Artificial Sequence
  Description of Artificial Sequence: Synthetic oligonucleotide
  Description of Combined DNA/RNA Molecule: Synthetic oligonucleotide
gguaauccgcuccagguuctt

SEQ ID NO: 177 - DNA, 21 bp, Artificial Sequence
  Description of Artificial Sequence: Synthetic oligonucleotide
  Description of Combined DNA/RNA Molecule: Synthetic oligonucleotide
aaccuggagcggauuaccctt

SEQ ID NO: 178 - DNA, 21 bp, Artificial Sequence
  Description of Artificial Sequence: Synthetic oligonucleotide
  Description of Combined DNA/RNA Molecule: Synthetic oligonucleotide
ggguaauccgcuccagguutt

SEQ ID NO: 179 - DNA, 21 bp, Artificial Sequence
  Description of Artificial Sequence: Synthetic oligonucleotide
  Description of Combined DNA/RNA Molecule: Synthetic oligonucleotide
cccuccacgguaccgggcgtt

SEQ ID NO: 180 - DNA, 21 bp, Artificial Sequence
  Description of Artificial Sequence: Synthetic oligonucleotide
  Description of Combined DNA/RNA Molecule: Synthetic oligonucleotide
cgcccgguaccguggagggtt

SEQ ID NO: 181 - DNA, 21 bp, Artificial Sequence
  Description of Artificial Sequence: Synthetic oligonucleotide
  Description of Combined DNA/RNA Molecule: Synthetic oligonucleotide
cacgguaccgggcggaugatt

SEQ ID NO: 182 - DNA, 21 bp, Artificial Sequence
  Description of Artificial Sequence: Synthetic oligonucleotide
  Description of Combined DNA/RNA Molecule: Synthetic oligonucleotide
ucauccgcccgguaccgugtt

SEQ ID NO: 183 - DNA, 21 bp, Artificial Sequence
  Description of Artificial Sequence: Synthetic oligonucleotide
  Description of Combined DNA/RNA Molecule: Synthetic oligonucleotide
cacgguaccgggcggaugatt

SEQ ID NO: 184 - DNA, 21 bp, Artificial Sequence
  Description of Artificial Sequence: Synthetic oligonucleotide
  Description of Combined DNA/RNA Molecule: Synthetic oligonucleotide
ucauccgcccgguaccgugtt

SEQ ID NO: 185 - DNA, 21 bp, Artificial Sequence
  Description of Artificial Sequence: Synthetic oligonucleotide
  Description of Combined DNA/RNA Molecule: Synthetic oligonucleotide
acgguaccgggcggaugaatt

SEQ ID NO: 186 - DNA, 21 bp, Artificial Sequence
  Description of Artificial Sequence: Synthetic oligonucleotide
  Description of Combined DNA/RNA Molecule: Synthetic oligonucleotide
uucauccgcccgguaccgutt

SEQ ID NO: 187 - DNA, 21 bp, Artificial Sequence
  Description of Artificial Sequence: Synthetic oligonucleotide
  Description of Combined DNA/RNA Molecule: Synthetic oligonucleotide
acgguaccgggcggaugaatt

SEQ ID NO: 188 - DNA, 21 bp, Artificial Sequence
  Description of Artificial Sequence: Synthetic oligonucleotide
  Description of Combined DNA/RNA Molecule: Synthetic oligonucleotide
uucauccgcccgguaccgutt

SEQ ID NO: 189 - DNA, 21 bp, Artificial Sequence
  Description of Artificial Sequence: Synthetic oligonucleotide
  Description of Combined DNA/RNA Molecule: Synthetic oligonucleotide
cgguaccgggcggaugaautt

SEQ ID NO: 190 - DNA, 21 bp, Artificial Sequence
  Description of Artificial Sequence: Synthetic oligonucleotide
  Description of Combined DNA/RNA Molecule: Synthetic oligonucleotide
auucauccgcccgguaccgtt

SEQ ID NO: 191 - DNA, 21 bp, Artificial Sequence
  Description of Artificial Sequence: Synthetic oligonucleotide
  Description of Combined DNA/RNA Molecule: Synthetic oligonucleotide
cgguaccgggcggaugaautt

SEQ ID NO: 192 - DNA, 21 bp, Artificial Sequence
  Description of Artificial Sequence: Synthetic oligonucleotide
  Description of Combined DNA/RNA Molecule: Synthetic oligonucleotide
auucauccgcccgguaccgtt

SEQ ID NO: 193 - DNA, 21 bp, Artificial Sequence
  Description of Artificial Sequence: Synthetic oligonucleotide
  Description of Combined DNA/RNA Molecule: Synthetic oligonucleotide
gguaccgggcggaugaauatt

SEQ ID NO: 194 - DNA, 21 bp, Artificial Sequence
  Description of Artificial Sequence: Synthetic oligonucleotide
  Description of Combined DNA/RNA Molecule: Synthetic oligonucleotide
uauucauccgcccgguacctt

SEQ ID NO: 195 - DNA, 21 bp, Artificial Sequence
  Description of Artificial Sequence: Synthetic oligonucleotide
  Description of Combined DNA/RNA Molecule: Synthetic oligonucleotide
gguaccgggcggaugaauatt

SEQ ID NO: 196 - DNA, 21 bp, Artificial Sequence
  Description of Artificial Sequence: Synthetic oligonucleotide
  Description of Combined DNA/RNA Molecule: Synthetic oligonucleotide
uauucauccgcccgguacctt

SEQ ID NO: 197 - DNA, 21 bp, Artificial Sequence
  Description of Artificial Sequence: Synthetic oligonucleotide
  Description of Combined DNA/RNA Molecule: Synthetic oligonucleotide
guaccgggcggaugaauactt

SEQ ID NO: 198 - DNA, 21 bp, Artificial Sequence
  Description of Artificial Sequence: Synthetic oligonucleotide
  Description of Combined DNA/RNA Molecule: Synthetic oligonucleotide
guauucauccgcccgguactt

SEQ ID NO: 199 - DNA, 21 bp, Artificial Sequence
  Description of Artificial Sequence: Synthetic oligonucleotide
  Description of Combined DNA/RNA Molecule: Synthetic oligonucleotide
guaccgggcggaugaauactt

SEQ ID NO: 200 - DNA, 21 bp, Artificial Sequence
  Description of Artificial Sequence: Synthetic oligonucleotide
  Description of Combined DNA/RNA Molecule: Synthetic oligonucleotide
guauucauccgcccgguactt

SEQ ID NO: 201 - DNA, 21 bp, Artificial Sequence
  Description of Artificial Sequence: Synthetic oligonucleotide
  Description of Combined DNA/RNA Molecule: Synthetic oligonucleotide
accgggcggaugaauaccatt

SEQ ID NO: 202 - DNA, 21 bp, Artificial Sequence
  Description of Artificial Sequence: Synthetic oligonucleotide
  Description of Combined DNA/RNA Molecule: Synthetic oligonucleotide
ugguauucauccgcccggutt

SEQ ID NO: 203 - DNA, 21 bp, Artificial Sequence
  Description of Artificial Sequence: Synthetic oligonucleotide
  Description of Combined DNA/RNA Molecule: Synthetic oligonucleotide
accgggcggaugaauaccatt

SEQ ID NO: 204 - DNA, 21 bp, Artificial Sequence
  Description of Artificial Sequence: Synthetic oligonucleotide
  Description of Combined DNA/RNA Molecule: Synthetic oligonucleotide
ugguauucauccgcccggutt

SEQ ID NO: 205 - DNA, 21 bp, Artificial Sequence
  Description of Artificial Sequence: Synthetic oligonucleotide
  Description of Combined DNA/RNA Molecule: Synthetic oligonucleotide
ccgggcggaugaauaccagtt

SEQ ID NO: 206 - DNA, 21 bp, Artificial Sequence
  Description of Artificial Sequence: Synthetic oligonucleotide
  Description of Combined DNA/RNA Molecule: Synthetic oligonucleotide
cugguauucauccgcccggtt

SEQ ID NO: 207 - DNA, 21 bp, Artificial Sequence
  Description of Artificial Sequence: Synthetic oligonucleotide
  Description of Combined DNA/RNA Molecule: Synthetic oligonucleotide
ccgggcggaugaauaccagtt

SEQ ID NO: 208 - DNA, 21 bp, Artificial Sequence
  Description of Artificial Sequence: Synthetic oligonucleotide
  Description of Combined DNA/RNA Molecule: Synthetic oligonucleotide
cugguauucauccgcccggtt

SEQ ID NO: 209 - DNA, 21 bp, Artificial Sequence
  Description of Artificial Sequence: Synthetic oligonucleotide
  Description of Combined DNA/RNA Molecule: Synthetic oligonucleotide
ccugguggagguguaucuctt

SEQ ID NO: 210 - DNA, 21 bp, Artificial Sequence
  Description of Artificial Sequence: Synthetic oligonucleotide
  Description of Combined DNA/RNA Molecule: Synthetic oligonucleotide
gagauacaccuccaccaggtt

SEQ ID NO: 211 - DNA, 21 bp, Artificial Sequence
  Description of Artificial Sequence: Synthetic oligonucleotide
  Description of Combined DNA/RNA Molecule: Synthetic oligonucleotide
ccugguggagguguaucuctt

SEQ ID NO: 212 - DNA, 21 bp, Artificial Sequence
  Description of Artificial Sequence: Synthetic oligonucleotide
  Description of Combined DNA/RNA Molecule: Synthetic oligonucleotide
gagauacaccuccaccaggtt

SEQ ID NO: 213 - DNA, 21 bp, Artificial Sequence
  Description of Artificial Sequence: Synthetic oligonucleotide
  Description of Combined DNA/RNA Molecule: Synthetic oligonucleotide
cugguggagguguaucucctt

SEQ ID NO: 214 - DNA, 21 bp, Artificial Sequence
  Description of Artificial Sequence: Synthetic oligonucleotide
  Description of Combined DNA/RNA Molecule: Synthetic oligonucleotide
ggagauacaccuccaccagtt

SEQ ID NO: 215 - DNA, 21 bp, Artificial Sequence
  Description of Artificial Sequence: Synthetic oligonucleotide
  Description of Combined DNA/RNA Molecule: Synthetic oligonucleotide
cugguggagguguaucucctt

SEQ ID NO: 216 - DNA, 21 bp, Artificial Sequence
  Description of Artificial Sequence: Synthetic oligonucleotide
  Description of Combined DNA/RNA Molecule: Synthetic oligonucleotide
ggagauacaccuccaccagtt

SEQ ID NO: 217 - DNA, 21 bp, Artificial Sequence
  Description of Artificial Sequence: Synthetic oligonucleotide
  Description of Combined DNA/RNA Molecule: Synthetic oligonucleotide
ugguggagguguaucuccutt

SEQ ID NO: 218 - DNA, 21 bp, Artificial Sequence
  Description of Artificial Sequence: Synthetic oligonucleotide
  Description of Combined DNA/RNA Molecule: Synthetic oligonucleotide
aggagauacaccuccaccatt

SEQ ID NO: 219 - DNA, 21 bp, Artificial Sequence
  Description of Artificial Sequence: Synthetic oligonucleotide
  Description of Combined DNA/RNA Molecule: Synthetic oligonucleotide
ugguggagguguaucuccutt

SEQ ID NO: 220 - DNA, 21 bp, Artificial Sequence
  Description of Artificial Sequence: Synthetic oligonucleotide
  Description of Combined DNA/RNA Molecule: Synthetic oligonucleotide
aggagauacaccuccaccatt

SEQ ID NO: 221 - DNA, 21 bp, Artificial Sequence
  Description of Artificial Sequence: Synthetic oligonucleotide
  Description of Combined DNA/RNA Molecule: Synthetic oligonucleotide
gguggagguguaucuccuatt

SEQ ID NO: 222 - DNA, 21 bp, Artificial Sequence
  Description of Artificial Sequence: Synthetic oligonucleotide
  Description of Combined DNA/RNA Molecule: Synthetic oligonucleotide
uaggagauacaccuccacctt

SEQ ID NO: 223 - DNA, 21 bp, Artificial Sequence
  Description of Artificial Sequence: Synthetic oligonucleotide
  Description of Combined DNA/RNA Molecule: Synthetic oligonucleotide
gguggagguguaucuccuatt

SEQ ID NO: 224 - DNA, 21 bp, Artificial Sequence
  Description of Artificial Sequence: Synthetic oligonucleotide
  Description of Combined DNA/RNA Molecule: Synthetic oligonucleotide
uaggagauacaccuccacctt

SEQ ID NO: 225 - DNA, 21 bp, Artificial Sequence
  Description of Artificial Sequence: Synthetic oligonucleotide
  Description of Combined DNA/RNA Molecule: Synthetic oligonucleotide
ggagguguaucuccuagactt

SEQ ID NO: 226 - DNA, 21 bp, Artificial Sequence
  Description of Artificial Sequence: Synthetic oligonucleotide
  Description of Combined DNA/RNA Molecule: Synthetic oligonucleotide
gucuaggagauacaccucctt

SEQ ID NO: 227 - DNA, 21 bp, Artificial Sequence
  Description of Artificial Sequence: Synthetic oligonucleotide
  Description of Combined DNA/RNA Molecule: Synthetic oligonucleotide
ggagguguaucuccuagactt

SEQ ID NO: 228 - DNA, 21 bp, Artificial Sequence
  Description of Artificial Sequence: Synthetic oligonucleotide
  Description of Combined DNA/RNA Molecule: Synthetic oligonucleotide
gucuaggagauacaccucctt

SEQ ID NO: 229 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 230 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 231 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 232 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 233 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 234 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 235 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 236 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 237 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 238 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 239 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 240 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 241 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 242 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 243 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 244 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 245 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 246 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 247 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 248 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 249 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 250 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 251 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 252 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 253 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 254 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 255 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 256 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 257 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 258 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 259 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 260 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 261 - DNA, 21 bp, Artificial Sequence
  Description of Artificial Sequence: Synthetic oligonucleotide
  Description of Combined DNA/RNA Molecule: Synthetic oligonucleotide
uguaucuccuagacaccagtt

SEQ ID NO: 262 - DNA, 21 bp, Artificial Sequence
  Description of Artificial Sequence: Synthetic oligonucleotide
  Description of Combined DNA/RNA Molecule: Synthetic oligonucleotide
cuggugucuaggagauacatt

SEQ ID NO: 263 - DNA, 21 bp, Artificial Sequence
  Description of Artificial Sequence: Synthetic oligonucleotide
  Description of Combined DNA/RNA Molecule: Synthetic oligonucleotide
uguaucuccuagacaccagtt

SEQ ID NO: 264 - DNA, 21 bp, Artificial Sequence
  Description of Artificial Sequence: Synthetic oligonucleotide
  Description of Combined DNA/RNA Molecule: Synthetic oligonucleotide
cuggugucuaggagauacatt

SEQ ID NO: 265 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 266 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 267 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 268 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 269 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 270 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 271 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 272 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 273 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 274 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 275 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 276 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 277 - DNA, 21 bp, Artificial Sequence
  Description of Artificial Sequence: Synthetic oligonucleotide
  Description of Combined DNA/RNA Molecule: Synthetic oligonucleotide
ucuccuaaacaccagcauatt

SEQ ID NO: 278 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 279 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 280 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 281 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 282 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 283 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 284 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 285 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 286 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 288 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 291 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 294 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 295 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 296 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 297 - DNA, 21 bp, Artificial Sequence
  Description of Artificial Sequence: Synthetic oligonucleotide
  Description of Combined DNA/RNA Molecule: Synthetic oligonucleotide
cuccuagacaccagcauactt

SEQ ID NO: 298 - DNA, 21 bp, Artificial Sequence
  Description of Artificial Sequence: Synthetic oligonucleotide
  Description of Combined DNA/RNA Molecule: Synthetic oligonucleotide
guaugcuggugucuaggagtt

SEQ ID NO: 299 - DNA, 21 bp, Artificial Sequence
  Description of Artificial Sequence: Synthetic oligonucleotide
  Description of Combined DNA/RNA Molecule: Synthetic oligonucleotide
cuccuagacaccagcauactt

SEQ ID NO: 300 - DNA, 21 bp, Artificial Sequence
  Description of Artificial Sequence: Synthetic oligonucleotide
  Description of Combined DNA/RNA Molecule: Synthetic oligonucleotide
guaugcuggugucuaggagtt

SEQ ID NO: 301 - DNA, 21 bp, Artificial Sequence
  Description of Artificial Sequence: Synthetic oligonucleotide
  Description of Combined DNA/RNA Molecule: Synthetic oligonucleotide
uccuagacaccagcauacatt

SEQ ID NO: 302 - DNA, 21 bp, Artificial Sequence
  Description of Artificial Sequence: Synthetic oligonucleotide
  Description of Combined DNA/RNA Molecule: Synthetic oligonucleotide
uguaugcuggugucuaggatt

SEQ ID NO: 303 - DNA, 21 bp, Artificial Sequence
  Description of Artificial Sequence: Synthetic oligonucleotide
  Description of Combined DNA/RNA Molecule: Synthetic oligonucleotide
uccuagacaccagcauacatt

SEQ ID NO: 304 - DNA, 21 bp, Artificial Sequence
  Description of Artificial Sequence: Synthetic oligonucleotide
  Description of Combined DNA/RNA Molecule: Synthetic oligonucleotide
uguaugcuggugucuaggatt

SEQ ID NO: 305 - DNA, 21 bp, Artificial Sequence
  Description of Artificial Sequence: Synthetic oligonucleotide
  Description of Combined DNA/RNA Molecule: Synthetic oligonucleotide
ccuagacaccagcauacagtt

SEQ ID NO: 306 - DNA, 21 bp, Artificial Sequence
  Description of Artificial Sequence: Synthetic oligonucleotide
  Description of Combined DNA/RNA Molecule: Synthetic oligonucleotide
cuguaugcuggugucuaggtt

SEQ ID NO: 307 - DNA, 21 bp, Artificial Sequence
  Description of Artificial Sequence: Synthetic oligonucleotide
  Description of Combined DNA/RNA Molecule: Synthetic oligonucleotide
ccuagacaccagcauacagtt

SEQ ID NO: 308 - DNA, 21 bp, Artificial Sequence
  Description of Artificial Sequence: Synthetic oligonucleotide
  Description of Combined DNA/RNA Molecule: Synthetic oligonucleotide
cuguaugcuggugucuaggtt

SEQ ID NO: 309 - DNA, 21 bp, Artificial Sequence
  Description of Artificial Sequence: Synthetic oligonucleotide
  Description of Combined DNA/RNA Molecule: Synthetic oligonucleotide
gacaccagcauacagagugtt

SEQ ID NO: 310 - DNA, 21 bp, Artificial Sequence
  Description of Artificial Sequence: Synthetic oligonucleotide
  Description of Combined DNA/RNA Molecule: Synthetic oligonucleotide
cacucuguaugcugguguctt

SEQ ID NO: 311 - DNA, 21 bp, Artificial Sequence
  Description of Artificial Sequence: Synthetic oligonucleotide
  Description of Combined DNA/RNA Molecule: Synthetic oligonucleotide
gacaccagcauacagagugtt

SEQ ID NO: 312 - DNA, 21 bp, Artificial Sequence
  Description of Artificial Sequence: Synthetic oligonucleotide
  Description of Combined DNA/RNA Molecule: Synthetic oligonucleotide
cacucuguaugcugguguctt

SEQ ID NO: 313 - DNA, 21 bp, Artificial Sequence
  Description of Artificial Sequence: Synthetic oligonucleotide
  Description of Combined DNA/RNA Molecule: Synthetic oligonucleotide
cauacagagugaccaccggtt

SEQ ID NO: 314 - DNA, 21 bp, Artificial Sequence
  Description of Artificial Sequence: Synthetic oligonucleotide
  Description of Combined DNA/RNA Molecule: Synthetic oligonucleotide
ccgguggucacucuguaugtt

SEQ ID NO: 315 - DNA, 21 bp, Artificial Sequence
  Description of Artificial Sequence: Synthetic oligonucleotide
  Description of Combined DNA/RNA Molecule: Synthetic oligonucleotide
cauacagagugaccaccggtt

SEQ ID NO: 316 - DNA, 21 bp, Artificial Sequence
  Description of Artificial Sequence: Synthetic oligonucleotide
  Description of Combined DNA/RNA Molecule: Synthetic oligonucleotide
ccgguggucacucuguaugtt

SEQ ID NO: 317 - DNA, 21 bp, Artificial Sequence
  Description of Artificial Sequence: Synthetic oligonucleotide
  Description of Combined DNA/RNA Molecule: Synthetic oligonucleotide
agagugaccaccgggaaautt

SEQ ID NO: 318 - DNA, 21 bp, Artificial Sequence
  Description of Artificial Sequence: Synthetic oligonucleotide
  Description of Combined DNA/RNA Molecule: Synthetic oligonucleotide
auuucccgguggucacucutt

SEQ ID NO: 319 - DNA, 21 bp, Artificial Sequence
  Description of Artificial Sequence: Synthetic oligonucleotide
  Description of Combined DNA/RNA Molecule: Synthetic oligonucleotide
agagugaccaccgggaaautt

SEQ ID NO: 320 - DNA, 21 bp, Artificial Sequence
  Description of Artificial Sequence: Synthetic oligonucleotide
  Description of Combined DNA/RNA Molecule: Synthetic oligonucleotide
auuucccgguggucacucutt

SEQ ID NO: 321 - DNA, 21 bp, Artificial Sequence
  Description of Artificial Sequence: Synthetic oligonucleotide
  Description of Combined DNA/RNA Molecule: Synthetic oligonucleotide
gagugaccaccgggaaauctt

SEQ ID NO: 322 - DNA, 21 bp, Artificial Sequence
  Description of Artificial Sequence: Synthetic oligonucleotide
  Description of Combined DNA/RNA Molecule: Synthetic oligonucleotide
gauuucccgguggucacuctt

SEQ ID NO: 323 - DNA, 21 bp, Artificial Sequence
  Description of Artificial Sequence: Synthetic oligonucleotide
  Description of Combined DNA/RNA Molecule: Synthetic oligonucleotide
gagugaccaccgggaaauctt

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
gauuucccgguggucacuctt

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
gugaccaccgggaaaucgatt

SEQ ID NO: 326 - DNA, 21 bp, Artificial Sequence
  Description of Artificial Sequence: Synthetic oligonucleotide
  Description of Combined DNA/RNA Molecule: Synthetic oligonucleotide
ucgauuucccgguggucactt

SEQ ID NO: 327 - DNA, 21 bp, Artificial Sequence
  Description of Artificial Sequence: Synthetic oligonucleotide
  Description of Combined DNA/RNA Molecule: Synthetic oligonucleotide
gugaccaccgggaaaucgatt

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
ucgauuucccgguggucactt

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
gaccaccgggaaaucgaggtt

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
ccucgauuucccggugguctt

SEQ ID NO: 331 - DNA, 21 bp, Artificial Sequence
  Description of Artificial Sequence: Synthetic oligonucleotide
  Description of Combined DNA/RNA Molecule: Synthetic oligonucleotide
gaccaccgggaaaucgaggtt

SEQ ID NO: 332 - DNA, 21 bp, Artificial Sequence
  Description of Artificial Sequence: Synthetic oligonucleotide
  Description of Combined DNA/RNA Molecule: Synthetic oligonucleotide
ccucgauuucccggugguctt

SEQ ID NO: 333 - DNA, 21 bp, Artificial Sequence
  Description of Artificial Sequence: Synthetic oligonucleotide
  Description of Combined DNA/RNA Molecule: Synthetic oligonucleotide
accaccgggaaaucgagggtt

SEQ ID NO: 334 - DNA, 21 bp, Artificial Sequence
  Description of Artificial Sequence: Synthetic oligonucleotide
  Description of Combined DNA/RNA Molecule: Synthetic oligonucleotide
cccucgauuucccgguggutt

SEQ ID NO: 335 - DNA, 21 bp, Artificial Sequence
  Description of Artificial Sequence: Synthetic oligonucleotide
  Description of Combined DNA/RNA Molecule: Synthetic oligonucleotide
accaccgggaaaucgagggtt

SEQ ID NO: 336 - DNA, 21 bp, Artificial Sequence
  Description of Artificial Sequence: Synthetic oligonucleotide
  Description of Combined DNA/RNA Molecule: Synthetic oligonucleotide
cccucgauuucccgguggutt

SEQ ID NO: 337 - DNA, 21 bp, Artificial Sequence
  Description of Artificial Sequence: Synthetic oligonucleotide
  Description of Combined DNA/RNA Molecule: Synthetic oligonucleotide
ccaccgggaaaucgagggctt

SEQ ID NO: 338 - DNA, 21 bp, Artificial Sequence
  Description of Artificial Sequence: Synthetic oligonucleotide
  Description of Combined DNA/RNA Molecule: Synthetic oligonucleotide
gcccucgauuucccgguggtt

SEQ ID NO: 339 - DNA, 21 bp, Artificial Sequence
  Description of Artificial Sequence: Synthetic oligonucleotide
  Description of Combined DNA/RNA Molecule: Synthetic oligonucleotide
ccaccgggaaaucgagggctt

SEQ ID NO: 340 - DNA, 21 bp, Artificial Sequence
  Description of Artificial Sequence: Synthetic oligonucleotide
  Description of Combined DNA/RNA Molecule: Synthetic oligonucleotide
gcccucgauuucccgguggtt

SEQ ID NO: 341 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 342 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 343 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 344 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 345 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 346 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 347 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 348 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 349 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 350 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 351 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 352 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 353 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 354 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 355 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 356 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 357 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 358 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 359 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 360 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 361 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 362 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 363 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 364 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 365 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 366 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 367 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 368 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 369 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 370 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 371 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 372 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 373 - DNA, 21 bp, Artificial Sequence
  Description of Artificial Sequence: Synthetic oligonucleotide
  Description of Combined DNA/RNA Molecule: Synthetic oligonucleotide
aucgagggcagggucauggtt

SEQ ID NO: 374 - DNA, 21 bp, Artificial Sequence
  Description of Artificial Sequence: Synthetic oligonucleotide
  Description of Combined DNA/RNA Molecule: Synthetic oligonucleotide
ccaugacccugcccucgautt

SEQ ID NO: 375 - DNA, 21 bp, Artificial Sequence
  Description of Artificial Sequence: Synthetic oligonucleotide
  Description of Combined DNA/RNA Molecule: Synthetic oligonucleotide
aucgagggcagggucauggtt

SEQ ID NO: 376 - DNA, 21 bp, Artificial Sequence
  Description of Artificial Sequence: Synthetic oligonucleotide
  Description of Combined DNA/RNA Molecule: Synthetic oligonucleotide
ccaugacccugcccucgautt

SEQ ID NO: 377 - DNA, 21 bp, Artificial Sequence
  Description of Artificial Sequence: Synthetic oligonucleotide
  Description of Combined DNA/RNA Molecule: Synthetic oligonucleotide
cgagggcagggucaugguctt

SEQ ID NO: 378 - DNA, 21 bp, Artificial Sequence
  Description of Artificial Sequence: Synthetic oligonucleotide
  Description of Combined DNA/RNA Molecule: Synthetic oligonucleotide
gaccaugacccugcccucgtt

SEQ ID NO: 379 - DNA, 21 bp, Artificial Sequence
  Description of Artificial Sequence: Synthetic oligonucleotide
  Description of Combined DNA/RNA Molecule: Synthetic oligonucleotide
gagggcagggucauggucatt

SEQ ID NO: 380 - DNA, 21 bp, Artificial Sequence
  Description of Artificial Sequence: Synthetic oligonucleotide
  Description of Combined DNA/RNA Molecule: Synthetic oligonucleotide
ugaccaugacccugcccuctt

SEQ ID NO: 381 - DNA, 21 bp, Artificial Sequence
  Description of Artificial Sequence: Synthetic oligonucleotide
  Description of Combined DNA/RNA Molecule: Synthetic oligonucleotide
gagggcagggucauggucatt

SEQ ID NO: 382 - DNA, 21 bp, Artificial Sequence
  Description of Artificial Sequence: Synthetic oligonucleotide
  Description of Combined DNA/RNA Molecule: Synthetic oligonucleotide
ugaccaugacccugcccuctt

SEQ ID NO: 383 - DNA, 21 bp, Artificial Sequence
  Description of Artificial Sequence: Synthetic oligonucleotide
  Description of Combined DNA/RNA Molecule: Synthetic oligonucleotide
gggcagggucauggucacctt

SEQ ID NO: 384 - DNA, 21 bp, Artificial Sequence
  Description of Artificial Sequence: Synthetic oligonucleotide
  Description of Combined DNA/RNA Molecule: Synthetic oligonucleotide
ggugaccaugacccugccctt

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
gggcagggucauggucacctt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
ggugaccaugacccugccctt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
cagggucauggucaccgactt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
gucggugaccaugacccugtt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
cagggucauggucaccgactt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
gucggugaccaugacccugtt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
agggucauggucaccgacutt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
agucggugaccaugacccutt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
agggucauggucaccgacutt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
agucggugaccaugacccutt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
auggucaccgacuucgagatt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
ucucgaagucggugaccautt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
auggucaccgacuucgagatt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
ucucgaagucggugaccautt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
ccgacuucgagaaugugcctt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
ggcacauucucgaagucggtt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
ggaggacgggacccgcuuctt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
gaagcgggucccguccucctt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
cagcggccgggaugccggctt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
gccggcaucccggccgcugtt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
cagcggccgggaugccggctt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
gccggcaucccggccgcugtt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
gggugccagcaugcgcagctt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
gcugcgcaugcuggcaccctt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
ccugcgcgugcucaacugctt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
gcaguugagcacgcgcaggtt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
ccugcgcgugcucaacugctt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
gcaguugagcacgcgcaggtt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
ugcgcgugcucaacugccatt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
uggcaguugagcacgcgcatt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
ugcgcgugcucaacugccatt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
uggcaguugagcacgcgcatt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
cgcgugcucaacugccaagtt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
cuuggcaguugagcacgcgtt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
cgcgugcucaacugccaagtt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
cuuggcaguugagcacgcgtt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
cugccaagggaagggcacgtt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
cgugcccuucccuuggcagtt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
cugccaagggaagggcacgtt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
cgugcccuucccuuggcagtt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
caagggaagggcacgguuatt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
uaaccgugcccuucccuugtt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
aagggaagggcacgguuagtt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
cuaaccgugcccuucccuutt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
agggaagggcacgguuagctt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
gcuaaccgugcccuucccutt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
gggaagggcacgguuagcgtt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
cgcuaaccgugcccuuccctt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
ggaagggcacgguuagcggtt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
ccgcuaaccgugcccuucctt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
gaagggcacgguuagcggctt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
gccgcuaaccgugcccuuctt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
aagggcacgguuagcggcatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
ugccgcuaaccgugcccuutt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
agggcacgguuagcggcactt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
gugccgcuaaccgugcccutt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
cacgguuagcggcacccuctt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
gagggugccgcuaaccgugtt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
acgguuagcggcacccucatt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
ugagggugccgcuaaccgutt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
guuagcggcacccucauagtt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
cuaugagggugccgcuaactt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
uuagcggcacccucauaggtt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
ccuaugagggugccgcuaatt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 462 - DNA, 20 bp, Artificial Sequence
  Description of Artificial Sequence: Synthetic oligonucleotide
  Description of Combined DNA/RNA Molecule: Synthetic oligonucleotide
uuccgaauaacuccaggctt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
cuggaguuuauucggaaaatt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
uuuuccgaauaaacuccagtt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
cuggaguuuauucggaaaatt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
uuuuccgaauaaacuccagtt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
ggaguuuauucggaaaagctt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
gcuuuuccgaauaaacucctt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
ggaguuuauucggaaaagctt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
gcuuuuccgaauaaacucctt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
gaguuuauucggaaaagcctt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
ggcuuuuccgaauaaacuctt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
gaguuuauucggaaaagcctt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
ggcuuuuccgaauaaacuctt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
uuauucggaaaagccagcutt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
agcuggcuuuuccgaauaatt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
uuauucggaaaagccagcutt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
agcuggcuuuuccgaauaatt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
cccuggcggguggguacagtt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
cuguacccacccgccagggtt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
cccuggcggguggguacagtt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
cuguacccacccgccagggtt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
ccuggcggguggguacagctt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
gcuguacccacccgccaggtt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
uggcggguggguacagccgtt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
cggcuguacccacccgccatt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
uggcggguggguacagccgtt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
cggcuguacccacccgccatt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
ggcggguggguacagccgctt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
gcggcuguacccacccgcctt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
gguggguacagccgcgucctt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
ggacgcggcuguacccacctt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
uggguacagccgcguccuctt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
gaggacgcggcuguacccatt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
gccgcguccucaacgccgctt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
gcggcguugaggacgcggctt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
ccgcguccucaacgccgcctt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
ggcggcguugaggacgcggtt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
gucgugcuggucaccgcugtt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
cagcggugaccagcacgactt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
gucgugcuggucaccgcugtt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
cagcggugaccagcacgactt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
ucgugcuggucaccgcugctt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
gcagcggugaccagcacgatt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
ucgugcuggucaccgcugctt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
gcagcggugaccagcacgatt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
uggucaccgcugccggcaatt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
uugccggcagcggugaccatt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
uggucaccgcugccggcaatt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
uugccggcagcggugaccatt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
ggucaccgcugccggcaactt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
guugccggcagcggugacctt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
ggucaccgcugccggcaactt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
guugccggcagcggugacctt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
caccgcugccggcaacuuctt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
gaaguugccggcagcggugtt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
caccgcugccggcaacuuctt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
gaaguugccggcagcggugtt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
ccgcugccggcaacuuccgtt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
cggaaguugccggcagcggtt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
ccgcugccggcaacuuccgtt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
cggaaguugccggcagcggtt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
cgcugccggcaacuuccggtt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
ccggaaguugccggcagcgtt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
cgcugccggcaacuuccggtt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
ccggaaguugccggcagcgtt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
gcugccggcaacuuccgggtt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
cccggaaguugccggcagctt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
gcugccggcaacuuccgggtt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
cccggaaguugccggcagctt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
cggcaacuuccgggacgautt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
aucgucccggaaguugccgtt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
cggcaacuuccgggacgautt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
aucgucccggaaguugccgtt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
ggcaacuuccgggacgaugtt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
caucgucccggaaguugcctt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
ggcaacuuccgggacgaugtt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
caucgucccggaaguugcctt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
uuccgggacgaugccugcctt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
ggcaggcaucgucccggaatt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
uuccgggacgaugccugcctt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
ggcaggcaucgucccggaatt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
ggacgaugccugccucuactt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
guagaggcaggcaucgucctt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
ggacgaugccugccucuactt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
guagaggcaggcaucgucctt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
ggacgaugccugccucuactt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
guagaggcaggcaucgucctt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
gcucccgaggucaucacagtt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
cugugaugaccucgggagctt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
cucccgaggucaucacagutt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
acugugaugaccucgggagtt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
ucccgaggucaucacaguutt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
aacugugaugaccucgggatt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
ccaagaccagccggugacctt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
ggucaccggcuggucuuggtt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
caagaccagccggugaccctt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
gggucaccggcuggucuugtt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
accaacuuuggccgcugugtt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
cacagcggccaaaguuggutt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
accaacuuuggccgcugugtt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
cacagcggccaaaguuggutt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
caacuuuggccgcugugugtt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
cacacagcggccaaaguugtt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
caacuuuggccgcugugugtt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
cacacagcggccaaaguugtt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
cgcuguguggaccucuuugtt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
caaagagguccacacagcgtt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
cgcuguguggaccucuuugtt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
caaagagguccacacagcgtt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
gacaucauuggugccuccatt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
uggaggcaccaaugauguctt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
gacaucauuggugccuccatt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
uggaggcaccaaugauguctt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
ucauuggugccuccagcgatt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
ucgcuggaggcaccaaugatt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
ucauuggugccuccagcgatt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
ucgcuggaggcaccaaugatt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
agcaccugcuuugugucactt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
gugacacaaagcaggugcutt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
agcaccugcuuugugucactt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
gugacacaaagcaggugcutt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
cacagagugggacaucacatt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
ugugaugucccacucugugtt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
augcugucugccgagccggtt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
ccggcucggcagacagcautt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
augcugucugccgagccggtt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
ccggcucggcagacagcautt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
gucugccgagccggagcuctt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
gagcuccggcucggcagactt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
gucugccgagccggagcuctt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
gagcuccggcucggcagactt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
guugaggcagagacugauctt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
gaucagucucugccucaactt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
guugaggcagagacugauctt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
gaucagucucugccucaactt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
gcagagacugauccacuuctt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
gaaguggaucagucucugctt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
gcagagacugauccacuuctt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
gaaguggaucagucucugctt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
agagacugauccacuucuctt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
gagaaguggaucagucucutt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
agagacugauccacuucuctt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
gagaaguggaucagucucutt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
uucucugccaaagaugucatt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
ugacaucuuuggcagagaatt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
uucucugccaaagaugucatt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
ugacaucuuuggcagagaatt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
cucugccaaagaugucauctt

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
gaugacaucuuuggcagagtt

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
cucugccaaagaugucauctt

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
gaugacaucuuuggcagagtt

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
cugaggaccagcggguacutt

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
aguacccgcugguccucagtt

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
cugaggaccagcggguacutt

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
aguacccgcugguccucagtt

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
ugaggaccagcggguacugtt

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
caguacccgcugguccucatt

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
ugaggaccagcggguacugtt

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
caguacccgcugguccucatt

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
acuguauggucagcacacutt

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
agugugcugaccauacagutt

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
uguauggucagcacacucgtt

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
cgagugugcugaccauacatt

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
guauggucagcacacucggtt

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
ccgagugugcugaccauactt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
ggauggccacagccgucgctt

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
gcgacggcuguggccaucctt

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
gauggccacagccgucgcctt

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
ggcgacggcuguggccauctt

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
caagcuggucugccgggcctt

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
ggcccggcagaccagcuugtt

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
cugccgggcccacaacgcutt

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
agcguugugggcccggcagtt

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
cugccgggcccacaacgcutt

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
agcguugugggcccggcagtt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
ugccgggcccacaacgcuutt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
aagcguugugggcccggcatt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
ugccgggcccacaacgcuutt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
aagcguugugggcccggcatt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
ccgggcccacaacgcuuuutt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
aaaagcguugugggcccggtt

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
ccgggcccacaacgcuuuutt

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
aaaagcguugugggcccggtt

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
gggcccacaacgcuuuuggtt

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
ccaaaagcguugugggccctt

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
gggcccacaacgcuuuuggtt

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
ccaaaagcguugugggccctt

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
ggugagggugucuacgccatt

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
uggcguagacacccucacctt

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
ggugagggugucuacgccatt

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
uggcguagacacccucacctt

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
gagggugucuacgccauugtt

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
caauggcguagacacccuctt

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
gagggugucuacgccauugtt

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
caauggcguagacacccuctt

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
gccaggugcugccugcuactt

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
guagcaggcagcaccuggctt

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
gccaggugcugccugcuactt

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
guagcaggcagcaccuggctt

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
ccaggugcugccugcuacctt

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
gguagcaggcagcaccuggtt

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
ccaggugcugccugcuacctt

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
gguagcaggcagcaccuggtt

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
acccacaagccgccugugctt

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
gcacaggcggcuugugggutt

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
gugcugaggccacgagguctt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
gaccucguggccucagcactt

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
gugcugaggccacgagguctt

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
gaccucguggccucagcactt

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
ggccacgaggucagcccaatt

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
uugggcugaccucguggcctt

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
cgaggucagcccaaccagutt

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
acugguugggcugaccucgtt

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
gucagcccaaccagugcgutt

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
acgcacugguugggcugactt

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
cagcccaaccagugcguggtt

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
ccacgcacugguugggcugtt

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
cacagggaggccagcaucctt

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
ggaugcuggccucccugugtt

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
ccagcauccacgcuuccugtt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
caggaagcguggaugcuggtt

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
ccagcauccacgcuuccugtt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
caggaagcguggaugcuggtt

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
aaggagcauggaaucccggtt

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
ccgggauuccaugcuccuutt

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
aaggagcauggaaucccggtt

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
ccgggauuccaugcuccuutt

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
aggagcauggaaucccggctt

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
gccgggauuccaugcuccutt

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
aggagcauggaaucccggctt

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
gccgggauuccaugcuccutt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
gagcauggaaucccggccctt

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
gggccgggauuccaugcuctt

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
gagcauggaaucccggccctt

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
gggccgggauuccaugcuctt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
gccuacgccguagacaacatt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
uguugucuacggcguaggctt

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
ccuacgccguagacaacactt

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
guguugucuacggcguaggtt

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
cuacgccguagacaacacgtt

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
cguguugucuacggcguagtt

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
uacgccguagacaacacgutt

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
acguguugucuacggcguatt

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
cgccguagacaacacgugutt

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
acacguguugucuacggcgtt

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
gccguagacaacacgugugtt

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
cacacguguugucuacggctt

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
ccguagacaacacgugugutt

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
acacacguguugucuacggtt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
cguagacaacacguguguatt

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
uacacacguguugucuacgtt

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
uagacaacacguguguagutt

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
acuacacacguguugucuatt

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
agacaacacguguguaguctt

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
gacuacacacguguugucutt

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
gacaacacguguguagucatt

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
ugacuacacacguguuguctt

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
acaacacguguguagucagtt

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
cugacuacacacguguugutt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
caacacguguguagucaggtt

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
ccugacuacacacguguugtt

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
cacguguguagucaggagctt

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
gcuccugacuacacacgugtt

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
acguguguagucaggagcctt

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
ggcuccugacuacacacgutt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
cguguguagucaggagccgtt

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
cggcuccugacuacacacgtt

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
uguguagucaggagccgggtt

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
cccggcuccugacuacacatt

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
gucaggagccgggacgucatt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
ugacgucccggcuccugactt

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
gucaggagccgggacgucatt

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
ugacgucccggcuccugactt

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
ucaggagccgggacgucagtt

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
cugacgucccggcuccugatt

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
ucaggagccgggacgucagtt

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
cugacgucccggcuccugatt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
caggagccgggacgucagctt

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
gcugacgucccggcuccugtt

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
caggagccgggacgucagctt

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
gcugacgucccggcuccugtt

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
agccgggacgucagcacuatt

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
uagugcugacgucccggcutt

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
ccgggacgucagcacuacatt

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
uguagugcugacgucccggtt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
ccgugacagccguugccautt

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
auggcaacggcugucacggtt

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
cccaucccaggaugggugutt

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
acacccauccugggaugggtt

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
caucccaggaugggugucutt

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
agacacccauccugggaugtt

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
agcuuuaaaaugguuccgatt

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
ucggaaccauuuuaaagcutt

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
gcuuuaaaaugguuccgactt

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
gucggaaccauuuuaaagctt

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
cuuuaaaaugguuccgacutt

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
agucggaaccauuuuaaagtt

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
uuuaaaaugguuccgacuutt

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
aagucggaaccauuuuaaatt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
uuaaaaugguuccgacuugtt

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
caagucggaaccauuuuaatt

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
uaaaaugguuccgacuugutt

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
acaagucggaaccauuuuatt

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
aaaaugguuccgacuuguctt

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
gacaagucggaaccauuuutt

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
aaaugguuccgacuugucctt

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
ggacaagucggaaccauuutt

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
aaugguuccgacuuguccctt

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
gggacaagucggaaccauutt

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
gguuccgacuugucccucutt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
agagggacaagucggaacctt

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
cuccauggccuggcacgagtt

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
cucgugccaggccauggagtt

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
ccauggccuggcacgagggtt

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
cccucgugccaggccauggtt

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
gaacucacucacucugggutt

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
acccagagugagugaguuctt

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
ucacucacucugggugccutt

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
aggcacccagagugagugatt

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
uuucaccauucaaacaggutt

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
accuguuugaauggugaaatt

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
cauucaaacaggucgagcutt

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
agcucgaccuguuugaaugtt

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
auucaaacaggucgagcugtt

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
cagcucgaccuguuugaautt

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
uucaaacaggucgagcugutt

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
acagcucgaccuguuugaatt

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
ucaaacaggucgagcugugtt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
cacagcucgaccuguuugatt

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
caaacaggucgagcugugctt

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
gcacagcucgaccuguuugtt

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
aaacaggucgagcugugcutt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
agcacagcucgaccuguuutt

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
aacaggucgagcugugcuctt

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
gagcacagcucgaccuguutt

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
caggucgagcugugcucggtt

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
ccgagcacagcucgaccugtt

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
aggucgagcugugcucgggtt

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
cccgagcacagcucgaccutt

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
gucgagcugugcucgggugtt

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
cacccgagcacagcucgactt

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
ucgagcugugcucgggugctt

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
gcacccgagcacagcucgatt

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
agcugcucccaaugugccgtt

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
cggcacauugggagcagcutt

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
gcugcucccaaugugccgatt

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
ucggcacauugggagcagctt

SEQ ID NO: 877 - DNA, 21 bp, Artificial Sequence
  Description of Artificial Sequence: Synthetic oligonucleotide
  Description of Combined DNA/RNA Molecule: Synthetic oligonucleotide
ugcucccaaugugccgaugtt

SEQ ID NO: 878 - DNA, 21 bp, Artificial Sequence
  Description of Artificial Sequence: Synthetic oligonucleotide
  Description of Combined DNA/RNA Molecule: Synthetic oligonucleotide
caucggcacauugggagcatt

SEQ ID NO: 879 - DNA, 21 bp, Artificial Sequence
  Description of Artificial Sequence: Synthetic oligonucleotide
  Description of Combined DNA/RNA Molecule: Synthetic oligonucleotide
ucccaaugugccgaugucctt

SEQ ID NO: 880 - DNA, 21 bp, Artificial Sequence
  Description of Artificial Sequence: Synthetic oligonucleotide
  Description of Combined DNA/RNA Molecule: Synthetic oligonucleotide
ggacaucggcacauugggatt

SEQ ID NO: 881 - DNA, 21 bp, Artificial Sequence
  Description of Artificial Sequence: Synthetic oligonucleotide
  Description of Combined DNA/RNA Molecule: Synthetic oligonucleotide
ccaaugugccgauguccgutt

SEQ ID NO: 882 - DNA, 21 bp, Artificial Sequence
  Description of Artificial Sequence: Synthetic oligonucleotide
  Description of Combined DNA/RNA Molecule: Synthetic oligonucleotide
acggacaucggcacauuggtt

SEQ ID NO: 883 - DNA, 21 bp, Artificial Sequence
  Description of Artificial Sequence: Synthetic oligonucleotide
  Description of Combined DNA/RNA Molecule: Synthetic oligonucleotide
caaugugccgauguccgugtt

SEQ ID NO: 884 - DNA, 21 bp, Artificial Sequence
  Description of Artificial Sequence: Synthetic oligonucleotide
  Description of Combined DNA/RNA Molecule: Synthetic oligonucleotide
cacggacaucggcacauugtt

SEQ ID NO: 885 - DNA, 21 bp, Artificial Sequence
  Description of Artificial Sequence: Synthetic oligonucleotide
  Description of Combined DNA/RNA Molecule: Synthetic oligonucleotide
aaugugccgauguccguggtt

SEQ ID NO: 886 - DNA, 21 bp, Artificial Sequence
  Description of Artificial Sequence: Synthetic oligonucleotide
  Description of Combined DNA/RNA Molecule: Synthetic oligonucleotide
ccacggacaucggcacauutt

SEQ ID NO: 887 - DNA, 21 bp, Artificial Sequence
  Description of Artificial Sequence: Synthetic oligonucleotide
  Description of Combined DNA/RNA Molecule: Synthetic oligonucleotide
ccgauguccgugggcagaatt

SEQ ID NO: 888 - DNA, 21 bp, Artificial Sequence
  Description of Artificial Sequence: Synthetic oligonucleotide
  Description of Combined DNA/RNA Molecule: Synthetic oligonucleotide
uucugcccacggacaucggtt

SEQ ID NO: 889 - DNA, 21 bp, Artificial Sequence
  Description of Artificial Sequence: Synthetic oligonucleotide
  Description of Combined DNA/RNA Molecule: Synthetic oligonucleotide
gauguccgugggcagaaugtt

SEQ ID NO: 890 - DNA, 21 bp, Artificial Sequence
  Description of Artificial Sequence: Synthetic oligonucleotide
  Description of Combined DNA/RNA Molecule: Synthetic oligonucleotide
cauucugcccacggacauctt

SEQ ID NO: 891 - DNA, 21 bp, Artificial Sequence
  Description of Artificial Sequence: Synthetic oligonucleotide
  Description of Combined DNA/RNA Molecule: Synthetic oligonucleotide
guccgugggcagaaugacutt

SEQ ID NO: 892 - DNA, 21 bp, Artificial Sequence
  Description of Artificial Sequence: Synthetic oligonucleotide
  Description of Combined DNA/RNA Molecule: Synthetic oligonucleotide
agucauucugcccacggactt

SEQ ID NO: 893 - DNA, 21 bp, Artificial Sequence
  Description of Artificial Sequence: Synthetic oligonucleotide
  Description of Combined DNA/RNA Molecule: Synthetic oligonucleotide
uccgugggcagaaugacuutt

SEQ ID NO: 894 - DNA, 21 bp, Artificial Sequence
  Description of Artificial Sequence: Synthetic oligonucleotide
  Description of Combined DNA/RNA Molecule: Synthetic oligonucleotide
aagucauucugcccacggatt

SEQ ID NO: 895 - DNA, 21 bp, Artificial Sequence
  Description of Artificial Sequence: Synthetic oligonucleotide
  Description of Combined DNA/RNA Molecule: Synthetic oligonucleotide
ugggcagaaugacuuuuautt

SEQ ID NO: 896 - DNA, 21 bp, Artificial Sequence
  Description of Artificial Sequence: Synthetic oligonucleotide
  Description of Combined DNA/RNA Molecule: Synthetic oligonucleotide
auaaaagucauucugcccatt

SEQ ID NO: 897 - DNA, 21 bp, Artificial Sequence
  Description of Artificial Sequence: Synthetic oligonucleotide
  Description of Combined DNA/RNA Molecule: Synthetic oligonucleotide
acuuuuauugagcucuugutt

SEQ ID NO: 898 - DNA, 21 bp, Artificial Sequence
  Description of Artificial Sequence: Synthetic oligonucleotide
  Description of Combined DNA/RNA Molecule: Synthetic oligonucleotide
acaagagcucaauaaaagutt

SEQ ID NO: 899 - DNA, 21 bp, Artificial Sequence
  Description of Artificial Sequence: Synthetic oligonucleotide
  Description of Combined DNA/RNA Molecule: Synthetic oligonucleotide
auugagcucuuguuccgugtt

SEQ ID NO: 900 - DNA, 21 bp, Artificial Sequence
  Description of Artificial Sequence: Synthetic oligonucleotide
  Description of Combined DNA/RNA Molecule: Synthetic oligonucleotide
cacggaacaagagcucaautt

SEQ ID NO: 901 - DNA, 21 bp, Artificial Sequence
  Description of Artificial Sequence: Synthetic oligonucleotide
  Description of Combined DNA/RNA Molecule: Synthetic oligonucleotide
agcucuuguuccgugccagtt

SEQ ID NO: 902 - DNA, 21 bp, Artificial Sequence
  Description of Artificial Sequence: Synthetic oligonucleotide
  Description of Combined DNA/RNA Molecule: Synthetic oligonucleotide
cuggcacggaacaagagcutt

SEQ ID NO: 903 - DNA, 21 bp, Artificial Sequence
  Description of Artificial Sequence: Synthetic oligonucleotide
  Description of Combined DNA/RNA Molecule: Synthetic oligonucleotide
gcucuuguuccgugccaggtt

SEQ ID NO: 904 - DNA, 21 bp, Artificial Sequence
  Description of Artificial Sequence: Synthetic oligonucleotide
  Description of Combined DNA/RNA Molecule: Synthetic oligonucleotide
ccuggcacggaacaagagctt

SEQ ID NO: 905 - DNA, 21 bp, Artificial Sequence
  Description of Artificial Sequence: Synthetic oligonucleotide
  Description of Combined DNA/RNA Molecule: Synthetic oligonucleotide
uguuccgugccaggcauuctt

SEQ ID NO: 906 - DNA, 21 bp, Artificial Sequence
  Description of Artificial Sequence: Synthetic oligonucleotide
  Description of Combined DNA/RNA Molecule: Synthetic oligonucleotide
gaaugccuggcacggaacatt

SEQ ID NO: 907 - DNA, 21 bp, Artificial Sequence
  Description of Artificial Sequence: Synthetic oligonucleotide
  Description of Combined DNA/RNA Molecule: Synthetic oligonucleotide
guuccgugccaggcauucatt

SEQ ID NO: 908 - DNA, 21 bp, Artificial Sequence
  Description of Artificial Sequence: Synthetic oligonucleotide
  Description of Combined DNA/RNA Molecule: Synthetic oligonucleotide
ugaaugccuggcacggaactt

SEQ ID NO: 909 - DNA, 21 bp, Artificial Sequence
  Description of Artificial Sequence: Synthetic oligonucleotide
  Description of Combined DNA/RNA Molecule: Synthetic oligonucleotide
uuccgugccaggcauucaatt

SEQ ID NO: 910 - DNA, 21 bp, Artificial Sequence
  Description of Artificial Sequence: Synthetic oligonucleotide
  Description of Combined DNA/RNA Molecule: Synthetic oligonucleotide
uugaaugccuggcacggaatt

SEQ ID NO: 911 - DNA, 21 bp, Artificial Sequence
  Description of Artificial Sequence: Synthetic oligonucleotide
  Description of Combined DNA/RNA Molecule: Synthetic oligonucleotide
cgugccaggcauucaaucctt

SEQ ID NO: 912 - DNA, 21 bp, Artificial Sequence
  Description of Artificial Sequence: Synthetic oligonucleotide
  Description of Combined DNA/RNA Molecule: Synthetic oligonucleotide
ggauugaaugccuggcacgtt

SEQ ID NO: 913 - DNA, 21 bp, Artificial Sequence
  Description of Artificial Sequence: Synthetic oligonucleotide
  Description of Combined DNA/RNA Molecule: Synthetic oligonucleotide
gugccaggcauucaauccutt

SEQ ID NO: 914 - DNA, 21 bp, Artificial Sequence
  Description of Artificial Sequence: Synthetic oligonucleotide
  Description of Combined DNA/RNA Molecule: Synthetic oligonucleotide
aggauugaaugccuggcactt

SEQ ID NO: 915 - DNA, 21 bp, Artificial Sequence
  Description of Artificial Sequence: Synthetic oligonucleotide
  Description of Combined DNA/RNA Molecule: Synthetic oligonucleotide
caauccucaggucuccacctt

SEQ ID NO: 916 - DNA, 21 bp, Artificial Sequence
  Description of Artificial Sequence: Synthetic oligonucleotide
  Description of Combined DNA/RNA Molecule: Synthetic oligonucleotide
gguggagaccugaggauugtt

SEQ ID NO: 917 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 918 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 919 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 920 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 921 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 922 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 923 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 924 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 925 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 926 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 927 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 928 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 929 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 930 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 932 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 933 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 934 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 935 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 936 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 937 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 938 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 939 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 940 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 941 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 942 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 943 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 944 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 945 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 946 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 947 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 948 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 949 - DNA, 21 bp, Artificial Sequence
  Description of Artificial Sequence: Synthetic oligonucleotide
  Description of Combined DNA/RNA Molecule: Synthetic oligonucleotide
gcaggauucuucccauggatt

SEQ ID NO: 950 - DNA, 21 bp, Artificial Sequence
  Description of Artificial Sequence: Synthetic oligonucleotide
  Description of Combined DNA/RNA Molecule: Synthetic oligonucleotide
uccaugggaagaauccugctt

SEQ ID NO: 951 - DNA, 21 bp, Artificial Sequence
  Description of Artificial Sequence: Synthetic oligonucleotide
  Description of Combined DNA/RNA Molecule: Synthetic oligonucleotide
ugcagggacaaacaucguutt

SEQ ID NO: 952 - DNA, 21 bp, Artificial Sequence
  Description of Artificial Sequence: Synthetic oligonucleotide
  Description of Combined DNA/RNA Molecule: Synthetic oligonucleotide
aacgauguuugucccugcatt

SEQ ID NO: 953 - DNA, 21 bp, Artificial Sequence
  Description of Artificial Sequence: Synthetic oligonucleotide
  Description of Combined DNA/RNA Molecule: Synthetic oligonucleotide
gcagggacaaacaucguugtt

SEQ ID NO: 954 - DNA, 21 bp, Artificial Sequence
  Description of Artificial Sequence: Synthetic oligonucleotide
  Description of Combined DNA/RNA Molecule: Synthetic oligonucleotide
caacgauguuugucccugctt

SEQ ID NO: 955 - DNA, 21 bp, Artificial Sequence
  Description of Artificial Sequence: Synthetic oligonucleotide
  Description of Combined DNA/RNA Molecule: Synthetic oligonucleotide
agggacaaacaucguugggtt

SEQ ID NO: 956 - DNA, 21 bp, Artificial Sequence
  Description of Artificial Sequence: Synthetic oligonucleotide
  Description of Combined DNA/RNA Molecule: Synthetic oligonucleotide
cccaacgauguuugucccutt

SEQ ID NO: 957 - DNA, 21 bp, Artificial Sequence
  Description of Artificial Sequence: Synthetic oligonucleotide
  Description of Combined DNA/RNA Molecule: Synthetic oligonucleotide
cccucaucuccagcuaacutt

SEQ ID NO: 958 - DNA, 21 bp, Artificial Sequence
  Description of Artificial Sequence: Synthetic oligonucleotide
  Description of Combined DNA/RNA Molecule: Synthetic oligonucleotide
aguuagcuggagaugagggtt

SEQ ID NO: 959 - DNA, 21 bp, Artificial Sequence
  Description of Artificial Sequence: Synthetic oligonucleotide
  Description of Combined DNA/RNA Molecule: Synthetic oligonucleotide
caucuccagcuaacuguggtt

SEQ ID NO: 960 - DNA, 21 bp, Artificial Sequence
  Description of Artificial Sequence: Synthetic oligonucleotide
  Description of Combined DNA/RNA Molecule: Synthetic oligonucleotide
ccacaguuagcuggagaugtt

SEQ ID NO: 961 - DNA, 21 bp, Artificial Sequence
  Description of Artificial Sequence: Synthetic oligonucleotide
  Description of Combined DNA/RNA Molecule: Synthetic oligonucleotide
gcucccugauuaauggaggtt

SEQ ID NO: 962 - DNA, 21 bp, Artificial Sequence
  Description of Artificial Sequence: Synthetic oligonucleotide
  Description of Combined DNA/RNA Molecule: Synthetic oligonucleotide
ccuccauuaaucagggagctt

SEQ ID NO: 963 - DNA, 21 bp, Artificial Sequence
  Description of Artificial Sequence: Synthetic oligonucleotide
  Description of Combined DNA/RNA Molecule: Synthetic oligonucleotide
cccugauuaauggaggcuutt

SEQ ID NO: 964 - DNA, 21 bp, Artificial Sequence
  Description of Artificial Sequence: Synthetic oligonucleotide
  Description of Combined DNA/RNA Molecule: Synthetic oligonucleotide
aagccuccauuaaucagggtt

SEQ ID NO: 965 - DNA, 21 bp, Artificial Sequence
  Description of Artificial Sequence: Synthetic oligonucleotide
  Description of Combined DNA/RNA Molecule: Synthetic oligonucleotide
ccugauuaauggaggcuuatt

SEQ ID NO: 966 - DNA, 21 bp, Artificial Sequence
  Description of Artificial Sequence: Synthetic oligonucleotide
  Description of Combined DNA/RNA Molecule: Synthetic oligonucleotide
uaagccuccauuaaucaggtt

SEQ ID NO: 967 - DNA, 21 bp, Artificial Sequence
  Description of Artificial Sequence: Synthetic oligonucleotide
  Description of Combined DNA/RNA Molecule: Synthetic oligonucleotide
ugauuaauggaggcuuagctt

SEQ ID NO: 968 - DNA, 21 bp, Artificial Sequence
  Description of Artificial Sequence: Synthetic oligonucleotide
  Description of Combined DNA/RNA Molecule: Synthetic oligonucleotide
gcuaagccuccauuaaucatt

SEQ ID NO: 969 - DNA, 21 bp, Artificial Sequence
  Description of Artificial Sequence: Synthetic oligonucleotide
  Description of Combined DNA/RNA Molecule: Synthetic oligonucleotide
gauuaauggaggcuuagcutt

SEQ ID NO: 970 - DNA, 21 bp, Artificial Sequence
  Description of Artificial Sequence: Synthetic oligonucleotide
  Description of Combined DNA/RNA Molecule: Synthetic oligonucleotide
agcuaagccuccauuaauctt

SEQ ID NO: 971 - DNA, 21 bp, Artificial Sequence
  Description of Artificial Sequence: Synthetic oligonucleotide
  Description of Combined DNA/RNA Molecule: Synthetic oligonucleotide
auuaauggaggcuuagcuutt

SEQ ID NO: 972 - DNA, 21 bp, Artificial Sequence
  Description of Artificial Sequence: Synthetic oligonucleotide
  Description of Combined DNA/RNA Molecule: Synthetic oligonucleotide
aagcuaagccuccauuaautt

SEQ ID NO: 973 - DNA, 21 bp, Artificial Sequence
  Description of Artificial Sequence: Synthetic oligonucleotide
  Description of Combined DNA/RNA Molecule: Synthetic oligonucleotide
uuaauggaggcuuagcuuutt

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
aaagcuaagccuccauuaatt

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
uuucuggauggcaucuagctt

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
gcuagaugccauccagaaatt

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
uuucuggauggcaucuagctt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
gcuagaugccauccagaaatt

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
uucuggauggcaucuagcctt

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
ggcuagaugccauccagaatt

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
uucuggauggcaucuagcctt

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
ggcuagaugccauccagaatt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
ucuggauggcaucuagccatt

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
uggcuagaugccauccagatt

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
ucuggauggcaucuagccatt

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
uggcuagaugccauccagatt

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
aggcuggagacaggugcgctt

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
gcgcaccugucuccagccutt

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
ggcuggagacaggugcgcctt

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
ggcgcaccugucuccagcctt

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
gcuggagacaggugcgccctt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
gggcgcaccugucuccagctt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
uuccugagccaccuuuacutt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
aguaaagguggcucaggaatt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
uccugagccaccuuuacuctt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
gaguaaagguggcucaggatt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
ccugagccaccuuuacucutt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
agaguaaagguggcucaggtt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
ugagccaccuuuacucugctt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
gcagaguaaagguggcucatt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
agccaccuuuacucugcuctt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
gagcagaguaaagguggcutt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
caccuuuacucugcucuautt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
auagagcagaguaaaggugtt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
uacucugcucuaugccaggtt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
ccuggcauagagcagaguatt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
uacucugcucuaugccaggtt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
ccuggcauagagcagaguatt

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
augccaggcugugcuagcatt

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
ugcuagcacagccuggcautt

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
aggcugugcuagcaacacctt

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
gguguugcuagcacagccutt

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
cugugcuagcaacacccaatt

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
uuggguguugcuagcacagtt

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
gcuagcaacacccaaaggutt

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
accuuuggguguugcuagctt

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
ggagccaucaccuaggacutt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
aguccuaggugauggcucctt

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
caccuaggacugacucggctt

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
gccgagucaguccuaggugtt

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
aggacugacucggcagugutt

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
acacugccgagucaguccutt

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
ggacugacucggcagugugtt

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
cacacugccgagucagucctt

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
uggugcaugcacugucucatt

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
ugagacagugcaugcaccatt

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
augcacugucucagccaactt

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
guuggcugagacagugcautt

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
cugucucagccaacccgcutt

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
agcggguuggcugagacagtt

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
cucagccaacccgcuccactt

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
guggagcggguuggcugagtt

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
cucagccaacccgcuccactt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
guggagcggguuggcugagtt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
gccaacccgcuccacuacctt

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
gguaguggagcggguuggctt

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
gccaacccgcuccacuacctt

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
gguaguggagcggguuggctt

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
aacccgcuccacuacccggtt

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
ccggguaguggagcggguutt

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
ccgcuccacuacccggcagtt

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
cugccggguaguggagcggtt

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
cuacccggcaggguacacatt

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
uguguacccugccggguagtt

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
uacccggcaggguacacautt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
auguguacccugccggguatt

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
acccggcaggguacacauutt

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
aauguguacccugccgggutt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
cccggcaggguacacauuctt

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
gaauguguacccugccgggtt

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
cggcaggguacacauucgctt

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
gcgaauguguacccugccgtt

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
gcaggguacacauucgcactt

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
gugcgaauguguacccugctt

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
caggguacacauucgcacctt

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
ggugcgaauguguacccugtt

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
aggguacacauucgcaccctt

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
gggugcgaauguguacccutt

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
ggaacugagccagaaacgctt

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
gcguuucuggcucaguucctt

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
gaacugagccagaaacgcatt

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
ugcguuucuggcucaguuctt

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
aacugagccagaaacgcagtt

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
cugcguuucuggcucaguutt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
ugagccagaaacgcagauutt

SEQ ID NO: 1066 - DNA, 21 bp, Artificial Sequence
  Description of Artificial Sequence: Synthetic oligonucleotide
  Description of Combined DNA/RNA Molecule: Synthetic oligonucleotide
aaucugcguuucuggcucatt

SEQ ID NO: 1067 - DNA, 21 bp, Artificial Sequence
  Description of Artificial Sequence: Synthetic oligonucleotide
  Description of Combined DNA/RNA Molecule: Synthetic oligonucleotide
agaaacgcagauugggcugtt

SEQ ID NO: 1068 - DNA, 21 bp, Artificial Sequence
  Description of Artificial Sequence: Synthetic oligonucleotide
  Description of Combined DNA/RNA Molecule: Synthetic oligonucleotide
cagcccaaucugcguuucutt

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
aacgcagauugggcuggcutt

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
agccagcccaaucugcguutt

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
ucuucuuacuucacccggctt

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
gccgggugaaguaagaagatt

SEQ ID NO: 1105 - DNA, 21 bp, Artificial Sequence
  Description of Artificial Sequence: Synthetic oligonucleotide
  Description of Combined DNA/RNA Molecule: Synthetic oligonucleotide
cuucuuacuucacccggcutt

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
agccgggugaaguaagaagtt

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
uucuuacuucacccggcugtt

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
cagccgggugaaguaagaatt

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
gggcuccucauuuuuacggtt

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
ccguaaaaaugaggagccctt

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
ggcuccucauuuuuacgggtt

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
cccguaaaaaugaggagcctt

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
gcuccucauuuuuacgggutt

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
acccguaaaaaugaggagctt

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
cuccucauuuuuacggguatt

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
uacccguaaaaaugaggagtt

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
uccucauuuuuacggguaatt

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
uuacccguaaaaaugaggatt

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
ccucauuuuuacggguaactt

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
guuacccguaaaaaugaggtt

SEQ ID NO: 1121 - DNA, 21 bp, Artificial Sequence
  Description of Artificial Sequence: Synthetic oligonucleotide
  Description of Combined DNA/RNA Molecule: Synthetic oligonucleotide
cucauuuuuacggguaacatt

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
uguuacccguaaaaaugagtt

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
cauuuuuacggguaacagutt

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
acuguuacccguaaaaaugtt

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
auuuuuacggguaacagugtt

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
cacuguuacccguaaaaautt

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
uuuacggguaacagugaggtt

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
ccucacuguuacccguaaatt

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
cagaccaggaagcucggugtt

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
caccgagcuuccuggucugtt

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
gaccaggaagcucggugagtt

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
cucaccgagcuuccugguctt

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
ccaggaagcucggugagugtt

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
cacucaccgagcuuccuggtt

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
ggaagcucggugagugaugtt

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
caucacucaccgagcuucctt

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
gugagugauggcagaacgatt

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
ucguucugccaucacucactt

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
gagugauggcagaacgaugtt

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
caucguucugccaucacuctt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
gauggcagaacgaugccugtt

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
caggcaucguucugccauctt

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
agaacgaugccugcaggcatt

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
ugccugcaggcaucguucutt

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
acgaugccugcaggcauggtt

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
ccaugccugcaggcaucgutt

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
gcaggcauggaacuuuuuctt

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
gaaaaaguuccaugccugctt

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
ggaacuuuuuccguuaucatt

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
ugauaacggaaaaaguucctt

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
gaacuuuuuccguuaucactt

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
gugauaacggaaaaaguuctt

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
aacuuuuuccguuaucacctt

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
ggugauaacggaaaaaguutt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
uaucacccaggccugauuctt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
gaaucaggccugggugauatt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
aggccugauucacuggccutt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
aggccagugaaucaggccutt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
ugauucacuggccuggcggtt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
ccgccaggccagugaaucatt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
auucacuggccuggcggagtt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
cuccgccaggccagugaautt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
gcuucuaaggcauggucggtt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
ccgaccaugccuuagaagctt

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
cuucuaaggcauggucgggtt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
cccgaccaugccuuagaagtt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
gagggccaacaacuguccctt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
gggacaguuguuggcccuctt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
acugucccuccuugagcactt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
gugcucaaggagggacagutt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
acugucccuccuugagcactt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
gugcucaaggagggacagutt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
cugucccuccuugagcacctt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
ggugcucaaggagggacagtt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
cugucccuccuugagcacctt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
ggugcucaaggagggacagtt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
ggcucaugcagcagauggctt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
ggcucaugcagcagauggctt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
ggcucaugcagcagauggctt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
cauuuaucuuuugggucugtt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
cagacccaaaagauaaaugtt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
cauuuaucuuuugggucugtt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
cagacccaaaagauaaaugtt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
uaucuuuugggucuguccutt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
aggacagacccaaaagauatt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
uaucuuuugggucuguccutt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
aggacagacccaaaagauatt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
cucuguugccuuuuuacagtt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
cuguaaaaaggcaacagagtt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
cucuguugccuuuuuacagtt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
cuguaaaaaggcaacagagtt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
ccuuuuuacagccaacuuutt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
aaaguuggcuguaaaaaggtt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
agccaacuuuucuagaccutt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
aggucuagaaaaguuggcutt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
acuuuucuagaccuguuuutt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
aaaacaggucuagaaaagutt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1239 - DNA, 20 bp, Artificial Sequence
  Description of Artificial Sequence: Synthetic oligonucleotide
  Description of Combined DNA/RNA Molecule: Synthetic oligonucleotide
uucuagaccuguuuucuutt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
ucuggguuuuguagcauuutt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
aaaugcuacaaaacccagatt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
ucuggguuuuguagcauuutt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
aaaugcuacaaaacccagatt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
auaaaaacaaacaaacguutt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
aacguuuguuuguuuuuautt

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
aaacaaacaaacguugucctt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
ggacaacguuuguuuguuutt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
aacaaacaaacguuguccutt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
aggacaacguuuguuuguutt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1327 - RNA, 19 nt, Artificial Sequence
  Description of Artificial Sequence: Synthetic oligonucleotide
gccuggaguuuauucggaa

SEQ ID NO: 1328 - RNA, 21 nt, Artificial Sequence
  Description of Artificial Sequence: Synthetic oligonucleotide
uuccgaauaaacuccaggccu

SEQ ID NO: 1329 - RNA, 20 nt, Artificial Sequence
  Description of Artificial Sequence: Synthetic oligonucleotide
gccuggaguuuauucggaaa

SEQ ID NO: 1330 - RNA, 22 nt, Artificial Sequence
  Description of Artificial Sequence: Synthetic oligonucleotide
uuuccgaauaaacuccaggccu

SEQ ID NO: 1331 - RNA, 21 nt, Artificial Sequence
  Description of Artificial Sequence: Synthetic oligonucleotide
gccuggaguuuauucggaaaa

SEQ ID NO: 1332 - RNA, 23 nt, Artificial Sequence
  Description of Artificial Sequence: Synthetic oligonucleotide
uuuuccgaauaaacuccaggccu

SEQ ID NO: 1333 - RNA, 22 nt, Artificial Sequence
  Description of Artificial Sequence: Synthetic oligonucleotide
gccuggaguuuauucggaaaag

SEQ ID NO: 1334 - RNA, 24 nt, Artificial Sequence
  Description of Artificial Sequence: Synthetic oligonucleotide
cuuuuccgaauaaacuccaggccu

SEQ ID NO: 1335 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1336 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1337 - DNA, 23 bp, Artificial Sequence
  Description of Artificial Sequence: Synthetic oligonucleotide
  Description of Combined DNA/RNA Molecule: Synthetic oligonucleotide
  modified_base (23)..(23): Abasic nucleotide
gccuggaguuuauucggaaattn

SEQ ID NO: 1338 - DNA, 23 bp, Artificial Sequence
  Description of Artificial Sequence: Synthetic oligonucleotide
  Description of Combined DNA/RNA Molecule: Synthetic oligonucleotide
  modified_base (23)..(23): Abasic nucleotide
uuuccgaauaaacuccaggcttn

SEQ ID NO: 1339 - DNA, 24 bp, Artificial Sequence
  Description of Artificial Sequence: Synthetic oligonucleotide
  Description of Combined DNA/RNA Molecule: Synthetic oligonucleotide
  modified_base (24)..(24): Abasic nucleotide
gccuggaguuuauucggaaaattn

SEQ ID NO: 1340 - DNA, 24 bp, Artificial Sequence
  Description of Artificial Sequence: Synthetic oligonucleotide
  Description of Combined DNA/RNA Molecule: Synthetic oligonucleotide
  modified_base (24)..(24): Abasic nucleotide
uuuuccgaauaaacuccaggcttn

SEQ ID NO: 1341 - DNA, 25 bp, Artificial Sequence
  Description of Artificial Sequence: Synthetic oligonucleotide
  Description of Combined DNA/RNA Molecule: Synthetic oligonucleotide
  modified_base (25)..(25): Abasic nucleotide
gccuggaguuuauucggaaaagttn

SEQ ID NO: 1342 - DNA, 25 bp, Artificial Sequence
  Description of Artificial Sequence: Synthetic oligonucleotide
  Description of Combined DNA/RNA Molecule: Synthetic oligonucleotide
  modified_base (25)..(25): Abasic nucleotide
cuuuuccgaauaaacuccaggcttn

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1344 - RNA, 21 nt, Artificial Sequence
  Description of Artificial Sequence: Synthetic oligonucleotide
uuccgaauaaacuccaggccu

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1346 - RNA, 21 nt, Artificial Sequence
  Description of Artificial Sequence: Synthetic oligonucleotide
uuccgaauaaacuccaggccu

SEQ ID NO: 1347 - RNA, 19 nt, Artificial Sequence
  Description of Artificial Sequence: Synthetic oligonucleotide
gccuggaguuuauucggaa

SEQ ID NO: 1348 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1349 - RNA, 19 nt, Artificial Sequence
  Description of Artificial Sequence: Synthetic oligonucleotide
gccuggaguuuauucggaa

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1351 - RNA, 19 nt, Artificial Sequence
  Description of Artificial Sequence: Synthetic oligonucleotide
gccuggaguuuauucggaa

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1353 - RNA, 19 nt, Artificial Sequence
  Description of Artificial Sequence: Synthetic oligonucleotide
gccuggaguuuauucggaa

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1355 - RNA, 19 nt, Artificial Sequence
  Description of Artificial Sequence: Synthetic oligonucleotide
gccuggaguuuauucggaa

SEQ ID NO: 1356 - RNA, 19 nt, Artificial Sequence
  Description of Artificial Sequence: Synthetic oligonucleotide
uuccgaauaaacuccaggc

SEQ ID NO: 1357 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, unknown or other
gccuggnaguuuauucggaatt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1359 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1360 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1361 - RNA, 19 nt, Artificial Sequence
  Description of Artificial Sequence: Synthetic oligonucleotide
gccuggaguuuauucggaa

SEQ ID NO: 1362 - RNA, 21 nt, Artificial Sequence
  Description of Artificial Sequence: Synthetic oligonucleotide
uuccgaauaaacuccaggccu

SEQ ID NO: 1363 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, unknown or other
gccuggnaguuuauucggaatt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1365 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1366 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1367 - RNA, 19 nt, Artificial Sequence
  Description of Artificial Sequence: Synthetic oligonucleotide
gccuggaguuuauucggaa

SEQ ID NO: 1368 - RNA, 21 nt, Artificial Sequence
  Description of Artificial Sequence: Synthetic oligonucleotide
uuccgaauaaacuccaggccu

SEQ ID NO: 1369 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, unknown or other
gccuggnaguuuauucggaatt

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1371 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1372 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1373 - RNA, 19 nt, Artificial Sequence
  Description of Artificial Sequence: Synthetic oligonucleotide
gccuggaguuuauucggaa

SEQ ID NO: 1374 - RNA, 21 nt, Artificial Sequence
  Description of Artificial Sequence: Synthetic oligonucleotide
uuccgaauaaacuccaggccu

SEQ ID NO: 1375 - RNA, 19 nt, Artificial Sequence
  Description of Artificial Sequence: Synthetic oligonucleotide
gccuggaguuuauucggaa

SEQ ID NO: 1376 - RNA, 19 nt, Artificial Sequence
  Description of Artificial Sequence: Synthetic oligonucleotide
uuccgaauaaacuccaggc

SEQ ID NO: 1377 - RNA, 19 nt, Artificial Sequence
  Description of Artificial Sequence: Synthetic oligonucleotide
gccuggaguuuauucggaa

SEQ ID NO: 1378 - RNA, 19 nt, Artificial Sequence
  Description of Artificial Sequence: Synthetic oligonucleotide
uuccgaauaaacuccaggc

SEQ ID NO: 1379 - RNA, 19 nt, Artificial Sequence
  Description of Artificial Sequence: Synthetic oligonucleotide
gccuggaguuuauucggaa

SEQ ID NO: 1380 - RNA, 19 nt, Artificial Sequence
  Description of Artificial Sequence: Synthetic oligonucleotide
uuccgaauaaacuccaggc

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1384 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1387 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1390 - RNA, 21 nt, Artificial Sequence
  Description of Artificial Sequence: Synthetic oligonucleotide
uuccgaauaaacuccaggccu

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1392 - RNA, 21 nt, Artificial Sequence
  Description of Artificial Sequence: Synthetic oligonucleotide
uuccgaauaaacuccaggccu

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1397 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, unknown or other
gccuggnaguuuauucggaatt

SEQ ID NO: 1398 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1399 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1400 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1401 - RNA, 19 nt, Artificial Sequence
  Description of Artificial Sequence: Synthetic oligonucleotide
gccuggaguuuauucggaa

SEQ ID NO: 1402 - RNA, 21 nt, Artificial Sequence
  Description of Artificial Sequence: Synthetic oligonucleotide
uuccgaauaaacuccaggccu

SEQ ID NO: 1403 - RNA, 19 nt, Artificial Sequence
  Description of Artificial Sequence: Synthetic oligonucleotide
gccuggaguuuauucggaa

SEQ ID NO: 1404 - RNA, 21 nt, Artificial Sequence
  Description of Artificial Sequence: Synthetic oligonucleotide
uuccgaauaaacuccaggccu

SEQ ID NO: 1405 - RNA, 19 nt, Artificial Sequence
  Description of Artificial Sequence: Synthetic oligonucleotide
gccuggaguuuauucggaa

SEQ ID NO: 1406 - RNA, 21 nt, Artificial Sequence
  Description of Artificial Sequence: Synthetic oligonucleotide
uuccgaauaaacuccaggccu

SEQ ID NO: 1407 - RNA, 19 nt, Artificial Sequence
  Description of Artificial Sequence: Synthetic oligonucleotide
gccuggaguuuauucggaa

SEQ ID NO: 1408 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1409 - RNA, 19 nt, Artificial Sequence
  Description of Artificial Sequence: Synthetic oligonucleotide
gccuggaguuuauucggaa

SEQ ID NO: 1410 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1411 - RNA, 19 nt, Artificial Sequence
  Description of Artificial Sequence: Synthetic oligonucleotide
gccuggaguuuauucggaa

SEQ ID NO: 1412 - RNA, 19 nt, Artificial Sequence
  Description of Artificial Sequence: Synthetic oligonucleotide
uuccgaauaaacuccaggc

SEQ ID NO: 1413 - RNA, 19 nt, Artificial Sequence
  Description of Artificial Sequence: Synthetic oligonucleotide
gccuggaguuuauucggaa

SEQ ID NO: 1414 - DNA, 19 bp, Artificial Sequence
  Description of Artificial Sequence: Synthetic oligonucleotide
  Description of Combined DNA/RNA Molecule: Synthetic oligonucleotide
uuccgaauaaacuccaggc

SEQ ID NO: 1415 - RNA, 19 nt, Artificial Sequence
  Description of Artificial Sequence: Synthetic oligonucleotide
gccuggaguuuauucggaa

SEQ ID NO: 1416 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggccu

SEQ ID NO: 1417 - RNA, 19 nt, Artificial Sequence
  Description of Artificial Sequence: Synthetic oligonucleotide
gccuggaguuuauucggaa

SEQ ID NO: 1418 - RNA, 21 nt, Artificial Sequence
  Description of Artificial Sequence: Synthetic oligonucleotide
uuccgaauaaacuccaggccu

SEQ ID NO: 1419 - RNA, 19 nt, Artificial Sequence
  Description of Artificial Sequence: Synthetic oligonucleotide
gccuggaguuuauucggaa

SEQ ID NO: 1420 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1421 - RNA, 19 nt, Artificial Sequence
  Description of Artificial Sequence: Synthetic oligonucleotide
gccuggaguuuauucggaa

SEQ ID NO: 1422 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1423 - RNA, 19 nt, Artificial Sequence
  Description of Artificial Sequence: Synthetic oligonucleotide
gccuggaguuuauucggaa

SEQ ID NO: 1424 - RNA, 21 nt, Artificial Sequence
  Description of Artificial Sequence: Synthetic oligonucleotide
uuccgaauaaacuccaggccu

SEQ ID NO: 1425 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1426 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1427 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1428 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1429 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1430 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1431 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1432 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1433 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1434 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1435 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1436 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1437 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1438 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1439 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1440 - RNA, 21 nt, Artificial Sequence
  Description of Artificial Sequence: Synthetic oligonucleotide
uuccgaauaaacuccaggccu

SEQ ID NO: 1441 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1442 - RNA, 21 nt, Artificial Sequence
  Description of Artificial Sequence: Synthetic oligonucleotide
uuccgaauaaacuccaggccu

SEQ ID NO: 1443 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1444 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1450 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1451 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1452 - RNA, 21 nt, Artificial Sequence
  Description of Artificial Sequence: Synthetic oligonucleotide
uuccgaauaaacuccaggccu

SEQ ID NO: 1453 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1454 - RNA, 21 nt, Artificial Sequence
  Description of Artificial Sequence: Synthetic oligonucleotide
uuccgaauaaacuccaggccu

SEQ ID NO: 1455 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1456 - RNA, 21 nt, Artificial Sequence
  Description of Artificial Sequence: Synthetic oligonucleotide
uuccgaauaaacuccaggccu

SEQ ID NO: 1457 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1458 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1459 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1460 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1461 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1462 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1463 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1464 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1465 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, unknown or other
gccuggnaguuuauucggaatt

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1467 - RNA, 19 nt, Artificial Sequence
  Description of Artificial Sequence: Synthetic oligonucleotide
gccuggaguuuauucggaa

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1469 - RNA, 20 nt, Artificial Sequence
  Description of Artificial Sequence: Synthetic oligonucleotide
gccuggagguuuauucggaa

SEQ ID NO: 1470 - RNA, 21 nt, Artificial Sequence
  Description of Artificial Sequence: Synthetic oligonucleotide
uuccgaauaaacuccaggccu

SEQ ID NO: 1471 - RNA, 20 nt, Artificial Sequence
  Description of Artificial Sequence: Synthetic oligonucleotide
gccuggagguuuauucggaa

SEQ ID NO: 1472 - RNA, 19 nt, Artificial Sequence
  Description of Artificial Sequence: Synthetic oligonucleotide
uuccgaauaaacuccaggc

SEQ ID NO: 1473 - RNA, 20 nt, Artificial Sequence
  Description of Artificial Sequence: Synthetic oligonucleotide
gccuggagguuuauucggaa

SEQ ID NO: 1474 - RNA, 21 nt, Artificial Sequence
  Description of Artificial Sequence: Synthetic oligonucleotide
uuccgaauaaacuccaggccu

SEQ ID NO: 1475 - RNA, 20 nt, Artificial Sequence
  Description of Artificial Sequence: Synthetic oligonucleotide
gccuggagguuuauucggaa

SEQ ID NO: 1476 - RNA, 21 nt, Artificial Sequence
  Description of Artificial Sequence: Synthetic oligonucleotide
uuccgaauaaacuccaggccu

SEQ ID NO: 1477 - RNA, 20 nt, Artificial Sequence
  Description of Artificial Sequence: Synthetic oligonucleotide
gccuggagguuuauucggaa

SEQ ID NO: 1478 - RNA, 19 nt, Artificial Sequence
  Description of Artificial Sequence: Synthetic oligonucleotide
uuccgaauaaacuccaggc

SEQ ID NO: 1479 - RNA, 20 nt, Artificial Sequence
  Description of Artificial Sequence: Synthetic oligonucleotide
gccuggagguuuauucggaa

SEQ ID NO: 1480 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1481 - RNA, 20 nt, Artificial Sequence
  Description of Artificial Sequence: Synthetic oligonucleotide
gccuggagguuuauucggaa

SEQ ID NO: 1482 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1483 - RNA, 20 nt, Artificial Sequence
  Description of Artificial Sequence: Synthetic oligonucleotide
gccuggagguuuauucggaa

SEQ ID NO: 1484 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1485 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1486 - RNA, 21 nt, Artificial Sequence
  Description of Artificial Sequence: Synthetic oligonucleotide
uuccgaauaaacuccaggccu

SEQ ID NO: 1487 - RNA, 19 nt, Artificial Sequence
  Description of Artificial Sequence: Synthetic oligonucleotide
gccuggaguuuauucggaa

SEQ ID NO: 1488 - RNA, 21 nt, Artificial Sequence
  Description of Artificial Sequence: Synthetic oligonucleotide
uuccgaauaaacuccaggccu

SEQ ID NO: 1489 - RNA, 19 nt, Artificial Sequence
  Description of Artificial Sequence: Synthetic oligonucleotide
gccuggaguuuauucggaa

SEQ ID NO: 1490 - RNA, 21 nt, Artificial Sequence
  Description of Artificial Sequence: Synthetic oligonucleotide
uuccgaauaaacuccaggccu

SEQ ID NO: 1491 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1492 - RNA, 21 nt, Artificial Sequence
  Description of Artificial Sequence: Synthetic oligonucleotide
uuccgaauaaacuccaggccu

SEQ ID NO: 1493 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, unknown or other
gccuggnaguuuauucggaatt

SEQ ID NO: 1494 - RNA, 21 nt, Artificial Sequence
  Description of Artificial Sequence: Synthetic oligonucleotide
uuccgaauaaacuccaggccu

SEQ ID NO: 1495 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1496 - RNA, 21 nt, Artificial Sequence
  Description of Artificial Sequence: Synthetic oligonucleotide
uuccgaauaaacuccaggccu

SEQ ID NO: 1497 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1498 - RNA, 21 nt, Artificial Sequence
  Description of Artificial Sequence: Synthetic oligonucleotide
uuccgaauaaacuccaggccu

SEQ ID NO: 1499 - RNA, 19 nt, Artificial Sequence
  Description of Artificial Sequence: Synthetic oligonucleotide
gccuggaguuuauucggaa

SEQ ID NO: 1500 - RNA, 21 nt, Artificial Sequence
  Description of Artificial Sequence: Synthetic oligonucleotide
uuccgaauaaacuccaggccu

SEQ ID NO: 1501 - RNA, 20 nt, Artificial Sequence
  Description of Artificial Sequence: Synthetic oligonucleotide
gccuggagguuuauucggaa

SEQ ID NO: 1502 - RNA, 21 nt, Artificial Sequence
  Description of Artificial Sequence: Synthetic oligonucleotide
uuccgaauaaacuccaggccu

SEQ ID NO: 1503 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1504 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1505 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1506 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1507 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1508 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1509 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1510 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1511 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1512 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1513 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1514 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1515 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1516 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1517 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 1518 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 1519 - DNA, 21 bp, Artificial Sequence
  Description of Artificial Sequence: Synthetic oligonucleotide
  Description of Combined DNA/RNA Molecule: Synthetic oligonucleotide
cuuacgcugaguacuucgatt

SEQ ID NO: 1520 - DNA, 21 bp, Artificial Sequence
  Description of Artificial Sequence: Synthetic oligonucleotide
  Description of Combined DNA/RNA Molecule: Synthetic oligonucleotide
ucgaaguacucagcguaagtt

SEQ ID NO: 1521 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1522 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1523 - RNA, 19 nt, Artificial Sequence
  Description of Artificial Sequence: Synthetic oligonucleotide
uucuagaccuguuuugcuu

SEQ ID NO: 1524 - RNA, 19 nt, Artificial Sequence
  Description of Artificial Sequence: Synthetic oligonucleotide
gccuggaguuuauucggaa

SEQ ID NO: 1525 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1526 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1528 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1529 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1532 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1533 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1534 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1536 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1537 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1539 - DNA, 20 bp, Artificial Sequence
  Description of Artificial Sequence: Synthetic oligonucleotide
  Description of Combined DNA/RNA Molecule: Synthetic oligonucleotide
uucuagacuguuuugcuutt

SEQ ID NO: 1540 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1541 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): difluorotoluyl ribo(or deoxyribo)nucleotide
uucuagacnuguuuugcuutt

SEQ ID NO: 1542 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1543 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): difluorotoluyl ribo(or deoxyribo)nucleotide
uucuagacnuguuuugcuutt

SEQ ID NO: 1544 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1545 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
uucuagaccnguuuugcuutt

SEQ ID NO: 1546 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1547 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
uucuagaccnguuuugcuutt

SEQ ID NO: 1548 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1549 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): difluorotoluyl ribo(or deoxyribo)nucleotide
uucuagaccunuuuugcuutt

SEQ ID NO: 1550 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1551 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): difluorotoluyl ribo(or deoxyribo)nucleotide
uucuagaccunuuuugcuutt

SEQ ID NO: 1552 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1553 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1554 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1555 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1556 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1557 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1558 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1559 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1560 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1561 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): difluorotoluyl ribo(or deoxyribo)nucleotide
uucuagacnuguuuugcuutt

SEQ ID NO: 1562 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1563 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): difluorotoluyl ribo(or deoxyribo)nucleotide
uucuagacnuguuuugcuutt

SEQ ID NO: 1564 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1565 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
uucuagaccnguuuugcuutt

SEQ ID NO: 1566 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1567 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
uucuagaccnguuuugcuutt

SEQ ID NO: 1568 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1569 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): difluorotoluyl ribo(or deoxyribo)nucleotide
uucuagaccunuuuugcuutt

SEQ ID NO: 1570 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1571 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): difluorotoluyl ribo(or deoxyribo)nucleotide
uucuagaccunuuuugcuutt

SEQ ID NO: 1572 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1573 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
gccuggagunuauucggaatt

SEQ ID NO: 1574 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1575 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
gccuggagunuauucggaatt

SEQ ID NO: 1576 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1577 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): difluorotoluyl ribo(or deoxyribo)nucleotide
gccuggagunuauucggaatt

SEQ ID NO: 1578 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1579 - DNA, 21 bp, Artificial Sequence
  Description of Artificial Sequence: Synthetic oligonucleotide
  Description of Combined DNA/RNA Molecule: Synthetic oligonucleotide
cagccaacuuuucuagacctt

SEQ ID NO: 1580 - DNA, 21 bp, Artificial Sequence
  Description of Artificial Sequence: Synthetic oligonucleotide
  Description of Combined DNA/RNA Molecule: Synthetic oligonucleotide
ggucuagaaaaguuggcugtt

SEQ ID NO: 1581 - DNA, 21 bp, Artificial Sequence
  Description of Artificial Sequence: Synthetic oligonucleotide
  Description of Combined DNA/RNA Molecule: Synthetic oligonucleotide
agccaacuuuucuagaccutt

SEQ ID NO: 1582 - DNA, 21 bp, Artificial Sequence
  Description of Artificial Sequence: Synthetic oligonucleotide
  Description of Combined DNA/RNA Molecule: Synthetic oligonucleotide
aggucuagaaaaguuggcutt

SEQ ID NO: 1583 - DNA, 21 bp, Artificial Sequence
  Description of Artificial Sequence: Synthetic oligonucleotide
  Description of Combined DNA/RNA Molecule: Synthetic oligonucleotide
gccaacuuuucuagaccugtt

SEQ ID NO: 1584 - DNA, 21 bp, Artificial Sequence
  Description of Artificial Sequence: Synthetic oligonucleotide
  Description of Combined DNA/RNA Molecule: Synthetic oligonucleotide
caggucuagaaaaguuggctt

SEQ ID NO: 1585 - DNA, 21 bp, Artificial Sequence
  Description of Artificial Sequence: Synthetic oligonucleotide
  Description of Combined DNA/RNA Molecule: Synthetic oligonucleotide
ccaacuuuucuagaccugutt

SEQ ID NO: 1586 - DNA, 21 bp, Artificial Sequence
  Description of Artificial Sequence: Synthetic oligonucleotide
  Description of Combined DNA/RNA Molecule: Synthetic oligonucleotide
acaggucuagaaaaguuggtt

SEQ ID NO: 1587 - DNA, 21 bp, Artificial Sequence
  Description of Artificial Sequence: Synthetic oligonucleotide
  Description of Combined DNA/RNA Molecule: Synthetic oligonucleotide
caacuuuucuagaccuguutt

SEQ ID NO: 1588 - DNA, 21 bp, Artificial Sequence
  Description of Artificial Sequence: Synthetic oligonucleotide
  Description of Combined DNA/RNA Molecule: Synthetic oligonucleotide
aacaggucuagaaaaguugtt

SEQ ID NO: 1589 - DNA, 21 bp, Artificial Sequence
  Description of Artificial Sequence: Synthetic oligonucleotide
  Description of Combined DNA/RNA Molecule: Synthetic oligonucleotide
aacuuuucuagaccuguuutt

SEQ ID NO: 1590 - DNA, 21 bp, Artificial Sequence
  Description of Artificial Sequence: Synthetic oligonucleotide
  Description of Combined DNA/RNA Molecule: Synthetic oligonucleotide
aaacaggucuagaaaaguutt

SEQ ID NO: 1591 - DNA, 21 bp, Artificial Sequence
  Description of Artificial Sequence: Synthetic oligonucleotide
  Description of Combined DNA/RNA Molecule: Synthetic oligonucleotide
acuuuucuagaccuguuuutt

SEQ ID NO: 1592 - DNA, 21 bp, Artificial Sequence
  Description of Artificial Sequence: Synthetic oligonucleotide
  Description of Combined DNA/RNA Molecule: Synthetic oligonucleotide
aaaacaggucuagaaaagutt

SEQ ID NO: 1593 - DNA, 21 bp, Artificial Sequence
  Description of Artificial Sequence: Synthetic oligonucleotide
  Description of Combined DNA/RNA Molecule: Synthetic oligonucleotide
cuuuucuagaccuguuuugtt

SEQ ID NO: 1594 - DNA, 21 bp, Artificial Sequence
  Description of Artificial Sequence: Synthetic oligonucleotide
  Description of Combined DNA/RNA Molecule: Synthetic oligonucleotide
caaaacaggucuagaaaagtt

SEQ ID NO: 1595 - DNA, 21 bp, Artificial Sequence
  Description of Artificial Sequence: Synthetic oligonucleotide
  Description of Combined DNA/RNA Molecule: Synthetic oligonucleotide
uuuucuagaccuguuuugctt

SEQ ID NO: 1596 - DNA, 21 bp, Artificial Sequence
  Description of Artificial Sequence: Synthetic oligonucleotide
  Description of Combined DNA/RNA Molecule: Synthetic oligonucleotide
gcaaaacaggucuagaaaatt

SEQ ID NO: 1597 - DNA, 21 bp, Artificial Sequence
  Description of Artificial Sequence: Synthetic oligonucleotide
  Description of Combined DNA/RNA Molecule: Synthetic oligonucleotide
uuucuagaccuguuuugcutt

SEQ ID NO: 1598 - DNA, 21 bp, Artificial Sequence
  Description of Artificial Sequence: Synthetic oligonucleotide
  Description of Combined DNA/RNA Molecule: Synthetic oligonucleotide
agcaaaacaggucuagaaatt

SEQ ID NO: 1599 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1600 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1601 - DNA, 21 bp, Artificial Sequence
  Description of Artificial Sequence: Synthetic oligonucleotide
  Description of Combined DNA/RNA Molecule: Synthetic oligonucleotide
cuagaccuguuuugcuuuutt

SEQ ID NO: 1602 - DNA, 21 bp, Artificial Sequence
  Description of Artificial Sequence: Synthetic oligonucleotide
  Description of Combined DNA/RNA Molecule: Synthetic oligonucleotide
aaaagcaaaacaggucuagtt

SEQ ID NO: 1603 - DNA, 21 bp, Artificial Sequence
  Description of Artificial Sequence: Synthetic oligonucleotide
  Description of Combined DNA/RNA Molecule: Synthetic oligonucleotide
uagaccuguuuugcuuuugtt

SEQ ID NO: 1604 - DNA, 21 bp, Artificial Sequence
  Description of Artificial Sequence: Synthetic oligonucleotide
  Description of Combined DNA/RNA Molecule: Synthetic oligonucleotide
caaaagcaaaacaggucuatt

SEQ ID NO: 1605 - DNA, 21 bp, Artificial Sequence
  Description of Artificial Sequence: Synthetic oligonucleotide
  Description of Combined DNA/RNA Molecule: Synthetic oligonucleotide
agaccuguuuugcuuuugutt

SEQ ID NO: 1606 - DNA, 21 bp, Artificial Sequence
  Description of Artificial Sequence: Synthetic oligonucleotide
  Description of Combined DNA/RNA Molecule: Synthetic oligonucleotide
acaaaagcaaaacaggucutt

SEQ ID NO: 1607 - DNA, 21 bp, Artificial Sequence
  Description of Artificial Sequence: Synthetic oligonucleotide
  Description of Combined DNA/RNA Molecule: Synthetic oligonucleotide
gaccuguuuugcuuuuguatt

SEQ ID NO: 1608 - DNA, 21 bp, Artificial Sequence
  Description of Artificial Sequence: Synthetic oligonucleotide
  Description of Combined DNA/RNA Molecule: Synthetic oligonucleotide
uacaaaagcaaaacagguctt

SEQ ID NO: 1609 - DNA, 21 bp, Artificial Sequence
  Description of Artificial Sequence: Synthetic oligonucleotide
  Description of Combined DNA/RNA Molecule: Synthetic oligonucleotide
accuguuuugcuuuuguaatt

SEQ ID NO: 1610 - DNA, 21 bp, Artificial Sequence
  Description of Artificial Sequence: Synthetic oligonucleotide
  Description of Combined DNA/RNA Molecule: Synthetic oligonucleotide
uuacaaaagcaaaacaggutt

SEQ ID NO: 1611 - DNA, 21 bp, Artificial Sequence
  Description of Artificial Sequence: Synthetic oligonucleotide
  Description of Combined DNA/RNA Molecule: Synthetic oligonucleotide
ccuguuuugcuuuuguaactt

SEQ ID NO: 1612 - DNA, 21 bp, Artificial Sequence
  Description of Artificial Sequence: Synthetic oligonucleotide
  Description of Combined DNA/RNA Molecule: Synthetic oligonucleotide
guuacaaaagcaaaacaggtt

SEQ ID NO: 1613 - DNA, 21 bp, Artificial Sequence
  Description of Artificial Sequence: Synthetic oligonucleotide
  Description of Combined DNA/RNA Molecule: Synthetic oligonucleotide
cuguuuugcuuuuguaacutt

SEQ ID NO: 1614 - DNA, 21 bp, Artificial Sequence
  Description of Artificial Sequence: Synthetic oligonucleotide
  Description of Combined DNA/RNA Molecule: Synthetic oligonucleotide
aguuacaaaagcaaaacagtt

SEQ ID NO: 1615 - DNA, 21 bp, Artificial Sequence
  Description of Artificial Sequence: Synthetic oligonucleotide
  Description of Combined DNA/RNA Molecule: Synthetic oligonucleotide
uguuuugcuuuuguaacuutt

SEQ ID NO: 1616 - DNA, 21 bp, Artificial Sequence
  Description of Artificial Sequence: Synthetic oligonucleotide
  Description of Combined DNA/RNA Molecule: Synthetic oligonucleotide
aaguuacaaaagcaaaacatt

SEQ ID NO: 1617 - DNA, 21 bp, Artificial Sequence
  Description of Artificial Sequence: Synthetic oligonucleotide
  Description of Combined DNA/RNA Molecule: Synthetic oligonucleotide
guuuugcuuuuguaacuugtt

SEQ ID NO: 1618 - DNA, 21 bp, Artificial Sequence
  Description of Artificial Sequence: Synthetic oligonucleotide
  Description of Combined DNA/RNA Molecule: Synthetic oligonucleotide
caaguuacaaaagcaaaactt

SEQ ID NO: 1619 - DNA, 21 bp, Artificial Sequence
  Description of Artificial Sequence: Synthetic oligonucleotide
  Description of Combined DNA/RNA Molecule: Synthetic oligonucleotide
uuuugcuuuuguaacuugatt

SEQ ID NO: 1620 - DNA, 21 bp, Artificial Sequence
  Description of Artificial Sequence: Synthetic oligonucleotide
  Description of Combined DNA/RNA Molecule: Synthetic oligonucleotide
ucaaguuacaaaagcaaaatt

SEQ ID NO: 1621 - DNA, 21 bp, Artificial Sequence
  Description of Artificial Sequence: Synthetic oligonucleotide
  Description of Combined DNA/RNA Molecule: Synthetic oligonucleotide
uuugcuuuuguaacuugaatt

SEQ ID NO: 1622 - DNA, 21 bp, Artificial Sequence
  Description of Artificial Sequence: Synthetic oligonucleotide
  Description of Combined DNA/RNA Molecule: Synthetic oligonucleotide
uucaaguuacaaaagcaaatt

SEQ ID NO: 1623 - DNA, 21 bp, Artificial Sequence
  Description of Artificial Sequence: Synthetic oligonucleotide
  Description of Combined DNA/RNA Molecule: Synthetic oligonucleotide
uugcuuuuguaacuugaagtt

SEQ ID NO: 1624 - DNA, 21 bp, Artificial Sequence
  Description of Artificial Sequence: Synthetic oligonucleotide
  Description of Combined DNA/RNA Molecule: Synthetic oligonucleotide
cuucaaguuacaaaagcaatt

SEQ ID NO: 1625 - DNA, 21 bp, Artificial Sequence
  Description of Artificial Sequence: Synthetic oligonucleotide
  Description of Combined DNA/RNA Molecule: Synthetic oligonucleotide
ugcuuuuguaacuugaagatt

SEQ ID NO: 1626 - DNA, 21 bp, Artificial Sequence
  Description of Artificial Sequence: Synthetic oligonucleotide
  Description of Combined DNA/RNA Molecule: Synthetic oligonucleotide
ucuucaaguuacaaaagcatt

SEQ ID NO: 1627 - DNA, 21 bp, Artificial Sequence
  Description of Artificial Sequence: Synthetic oligonucleotide
  Description of Combined DNA/RNA Molecule: Synthetic oligonucleotide
gcuuuuguaacuugaagautt

SEQ ID NO: 1628 - DNA, 21 bp, Artificial Sequence
  Description of Artificial Sequence: Synthetic oligonucleotide
  Description of Combined DNA/RNA Molecule: Synthetic oligonucleotide
aucuucaaguuacaaaagctt

SEQ ID NO: 1629 - DNA, 21 bp, Artificial Sequence
  Description of Artificial Sequence: Synthetic oligonucleotide
  Description of Combined DNA/RNA Molecule: Synthetic oligonucleotide
cuuuuguaacuugaagauatt

SEQ ID NO: 1630 - DNA, 21 bp, Artificial Sequence
  Description of Artificial Sequence: Synthetic oligonucleotide
  Description of Combined DNA/RNA Molecule: Synthetic oligonucleotide
uaucuucaaguuacaaaagtt

SEQ ID NO: 1631 - DNA, 21 bp, Artificial Sequence
  Description of Artificial Sequence: Synthetic oligonucleotide
  Description of Combined DNA/RNA Molecule: Synthetic oligonucleotide
uuuuguaacuugaagauautt

SEQ ID NO: 1632 - DNA, 21 bp, Artificial Sequence
  Description of Artificial Sequence: Synthetic oligonucleotide
  Description of Combined DNA/RNA Molecule: Synthetic oligonucleotide
auaucuucaaguuacaaaatt

SEQ ID NO: 1633 - DNA, 21 bp, Artificial Sequence
  Description of Artificial Sequence: Synthetic oligonucleotide
  Description of Combined DNA/RNA Molecule: Synthetic oligonucleotide
uuuguaacuugaagauauutt

SEQ ID NO: 1634 - DNA, 21 bp, Artificial Sequence
  Description of Artificial Sequence: Synthetic oligonucleotide
  Description of Combined DNA/RNA Molecule: Synthetic oligonucleotide
aauaucuucaaguuacaaatt

SEQ ID NO: 1635 - DNA, 21 bp, Artificial Sequence
  Description of Artificial Sequence: Synthetic oligonucleotide
  Description of Combined DNA/RNA Molecule: Synthetic oligonucleotide
uuguaacuugaagauauuutt

SEQ ID NO: 1636 - DNA, 21 bp, Artificial Sequence
  Description of Artificial Sequence: Synthetic oligonucleotide
  Description of Combined DNA/RNA Molecule: Synthetic oligonucleotide
aaauaucuucaaguuacaatt

SEQ ID NO: 1637 - DNA, 21 bp, Artificial Sequence
  Description of Artificial Sequence: Synthetic oligonucleotide
  Description of Combined DNA/RNA Molecule: Synthetic oligonucleotide
uguaacuugaagauauuuatt

SEQ ID NO: 1638 - DNA, 21 bp, Artificial Sequence
  Description of Artificial Sequence: Synthetic oligonucleotide
  Description of Combined DNA/RNA Molecule: Synthetic oligonucleotide
uaaauaucuucaaguuacatt

SEQ ID NO: 1639 - DNA, 21 bp, Artificial Sequence
  Description of Artificial Sequence: Synthetic oligonucleotide
  Description of Combined DNA/RNA Molecule: Synthetic oligonucleotide
guaacuugaagauauuuautt

SEQ ID NO: 1640 - DNA, 21 bp, Artificial Sequence
  Description of Artificial Sequence: Synthetic oligonucleotide
  Description of Combined DNA/RNA Molecule: Synthetic oligonucleotide
auaaauaucuucaaguuactt

SEQ ID NO: 1641 - DNA, 21 bp, Artificial Sequence
  Description of Artificial Sequence: Synthetic oligonucleotide
  Description of Combined DNA/RNA Molecule: Synthetic oligonucleotide
uaacuugaagauauuuauutt

SEQ ID NO: 1642 - DNA, 21 bp, Artificial Sequence
  Description of Artificial Sequence: Synthetic oligonucleotide
  Description of Combined DNA/RNA Molecule: Synthetic oligonucleotide
aauaaauaucuucaaguuatt

SEQ ID NO: 1643 - DNA, 21 bp, Artificial Sequence
  Description of Artificial Sequence: Synthetic oligonucleotide
  Description of Combined DNA/RNA Molecule: Synthetic oligonucleotide
aacuugaagauauuuauuctt

SEQ ID NO: 1644 - DNA, 21 bp, Artificial Sequence
  Description of Artificial Sequence: Synthetic oligonucleotide
  Description of Combined DNA/RNA Molecule: Synthetic oligonucleotide
gaauaaauaucuucaaguutt

SEQ ID NO: 1645 - DNA, 21 bp, Artificial Sequence
  Description of Artificial Sequence: Synthetic oligonucleotide
  Description of Combined DNA/RNA Molecule: Synthetic oligonucleotide
acuugaagauauuuauucutt

SEQ ID NO: 1646 - DNA, 21 bp, Artificial Sequence
  Description of Artificial Sequence: Synthetic oligonucleotide
  Description of Combined DNA/RNA Molecule: Synthetic oligonucleotide
agaauaaauaucuucaagutt

SEQ ID NO: 1647 - DNA, 21 bp, Artificial Sequence
  Description of Artificial Sequence: Synthetic oligonucleotide
  Description of Combined DNA/RNA Molecule: Synthetic oligonucleotide
cuugaagauauuuauucugtt

SEQ ID NO: 1648 - DNA, 21 bp, Artificial Sequence
  Description of Artificial Sequence: Synthetic oligonucleotide
  Description of Combined DNA/RNA Molecule: Synthetic oligonucleotide
cagaauaaauaucuucaagtt

SEQ ID NO: 1649 - DNA, 21 bp, Artificial Sequence
  Description of Artificial Sequence: Synthetic oligonucleotide
  Description of Combined DNA/RNA Molecule: Synthetic oligonucleotide
uugaagauauuuauucuggtt

SEQ ID NO: 1650 - DNA, 21 bp, Artificial Sequence
  Description of Artificial Sequence: Synthetic oligonucleotide
  Description of Combined DNA/RNA Molecule: Synthetic oligonucleotide
ccagaauaaauaucuucaatt

SEQ ID NO: 1651 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1652 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1653 - DNA, 21 bp, Artificial Sequence
  Description of Artificial Sequence: Synthetic oligonucleotide
  Description of Combined DNA/RNA Molecule: Synthetic oligonucleotide
gaagauauuuauucugggutt

SEQ ID NO: 1654 - DNA, 21 bp, Artificial Sequence
  Description of Artificial Sequence: Synthetic oligonucleotide
  Description of Combined DNA/RNA Molecule: Synthetic oligonucleotide
acccagaauaaauaucuuctt

SEQ ID NO: 1655 - DNA, 21 bp, Artificial Sequence
  Description of Artificial Sequence: Synthetic oligonucleotide
  Description of Combined DNA/RNA Molecule: Synthetic oligonucleotide
cagccaacuuuucuagacctt

SEQ ID NO: 1656 - DNA, 21 bp, Artificial Sequence
  Description of Artificial Sequence: Synthetic oligonucleotide
  Description of Combined DNA/RNA Molecule: Synthetic oligonucleotide
ggucuagaaaaguuggcugtt

SEQ ID NO: 1657 - DNA, 21 bp, Artificial Sequence
  Description of Artificial Sequence: Synthetic oligonucleotide
  Description of Combined DNA/RNA Molecule: Synthetic oligonucleotide
agccaacuuuucuagaccutt

SEQ ID NO: 1658 - DNA, 21 bp, Artificial Sequence
  Description of Artificial Sequence: Synthetic oligonucleotide
  Description of Combined DNA/RNA Molecule: Synthetic oligonucleotide
aggucuagaaaaguuggcutt

SEQ ID NO: 1659 - DNA, 21 bp, Artificial Sequence
  Description of Artificial Sequence: Synthetic oligonucleotide
  Description of Combined DNA/RNA Molecule: Synthetic oligonucleotide
gccaacuuuucuagaccugtt

SEQ ID NO: 1660 - DNA, 21 bp, Artificial Sequence
  Description of Artificial Sequence: Synthetic oligonucleotide
  Description of Combined DNA/RNA Molecule: Synthetic oligonucleotide
caggucuagaaaaguuggctt

SEQ ID NO: 1661 - DNA, 21 bp, Artificial Sequence
  Description of Artificial Sequence: Synthetic oligonucleotide
  Description of Combined DNA/RNA Molecule: Synthetic oligonucleotide
ccaacuuuucuagaccugutt

SEQ ID NO: 1662 - DNA, 21 bp, Artificial Sequence
  Description of Artificial Sequence: Synthetic oligonucleotide
  Description of Combined DNA/RNA Molecule: Synthetic oligonucleotide
acaggucuagaaaaguuggtt

SEQ ID NO: 1663 - DNA, 21 bp, Artificial Sequence
  Description of Artificial Sequence: Synthetic oligonucleotide
  Description of Combined DNA/RNA Molecule: Synthetic oligonucleotide
caacuuuucuagaccuguutt

SEQ ID NO: 1664 - DNA, 21 bp, Artificial Sequence
  Description of Artificial Sequence: Synthetic oligonucleotide
  Description of Combined DNA/RNA Molecule: Synthetic oligonucleotide
aacaggucuagaaaaguugtt

SEQ ID NO: 1665 - DNA, 21 bp, Artificial Sequence
  Description of Artificial Sequence: Synthetic oligonucleotide
  Description of Combined DNA/RNA Molecule: Synthetic oligonucleotide
aacuuuucuagaccuguuutt

SEQ ID NO: 1666 - DNA, 21 bp, Artificial Sequence
  Description of Artificial Sequence: Synthetic oligonucleotide
  Description of Combined DNA/RNA Molecule: Synthetic oligonucleotide
aaacaggucuagaaaaguutt

SEQ ID NO: 1667 - DNA, 21 bp, Artificial Sequence
  Description of Artificial Sequence: Synthetic oligonucleotide
  Description of Combined DNA/RNA Molecule: Synthetic oligonucleotide
acuuuucuagaccuguuuutt

SEQ ID NO: 1668 - DNA, 21 bp, Artificial Sequence
  Description of Artificial Sequence: Synthetic oligonucleotide
  Description of Combined DNA/RNA Molecule: Synthetic oligonucleotide
aaaacaggucuagaaaagutt

SEQ ID NO: 1669 - DNA, 21 bp, Artificial Sequence
  Description of Artificial Sequence: Synthetic oligonucleotide
  Description of Combined DNA/RNA Molecule: Synthetic oligonucleotide
cuuuucuagaccuguuuugtt

SEQ ID NO: 1670 - DNA, 21 bp, Artificial Sequence
  Description of Artificial Sequence: Synthetic oligonucleotide
  Description of Combined DNA/RNA Molecule: Synthetic oligonucleotide
caaaacaggucuagaaaagtt

SEQ ID NO: 1671 - DNA, 21 bp, Artificial Sequence
  Description of Artificial Sequence: Synthetic oligonucleotide
  Description of Combined DNA/RNA Molecule: Synthetic oligonucleotide
uuuucuagaccuguuuugctt

SEQ ID NO: 1672 - DNA, 21 bp, Artificial Sequence
  Description of Artificial Sequence: Synthetic oligonucleotide
  Description of Combined DNA/RNA Molecule: Synthetic oligonucleotide
gcaaaacaggucuagaaaatt

SEQ ID NO: 1673 - DNA, 21 bp, Artificial Sequence
  Description of Artificial Sequence: Synthetic oligonucleotide
  Description of Combined DNA/RNA Molecule: Synthetic oligonucleotide
uuucuagaccuguuuugcutt

SEQ ID NO: 1674 - DNA, 21 bp, Artificial Sequence
  Description of Artificial Sequence: Synthetic oligonucleotide
  Description of Combined DNA/RNA Molecule: Synthetic oligonucleotide
agcaaaacaggucuagaaatt

SEQ ID NO: 1675 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1676 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1677 - DNA, 21 bp, Artificial Sequence
  Description of Artificial Sequence: Synthetic oligonucleotide
  Description of Combined DNA/RNA Molecule: Synthetic oligonucleotide
cuagaccuguuuugcuuuutt

SEQ ID NO: 1678 - DNA, 21 bp, Artificial Sequence
  Description of Artificial Sequence: Synthetic oligonucleotide
  Description of Combined DNA/RNA Molecule: Synthetic oligonucleotide
aaaagcaaaacaggucuagtt

SEQ ID NO: 1679 - DNA, 21 bp, Artificial Sequence
  Description of Artificial Sequence: Synthetic oligonucleotide
  Description of Combined DNA/RNA Molecule: Synthetic oligonucleotide
uagaccuguuuugcuuuugtt

SEQ ID NO: 1680 - DNA, 21 bp, Artificial Sequence
  Description of Artificial Sequence: Synthetic oligonucleotide
  Description of Combined DNA/RNA Molecule: Synthetic oligonucleotide
caaaagcaaaacaggucuatt

SEQ ID NO: 1681 - DNA, 21 bp, Artificial Sequence
  Description of Artificial Sequence: Synthetic oligonucleotide
  Description of Combined DNA/RNA Molecule: Synthetic oligonucleotide
agaccuguuuugcuuuugutt

SEQ ID NO: 1682 - DNA, 21 bp, Artificial Sequence
  Description of Artificial Sequence: Synthetic oligonucleotide
  Description of Combined DNA/RNA Molecule: Synthetic oligonucleotide
acaaaagcaaaacaggucutt

SEQ ID NO: 1683 - DNA, 21 bp, Artificial Sequence
  Description of Artificial Sequence: Synthetic oligonucleotide
  Description of Combined DNA/RNA Molecule: Synthetic oligonucleotide
gaccuguuuugcuuuuguatt

SEQ ID NO: 1684 - DNA, 21 bp, Artificial Sequence
  Description of Artificial Sequence: Synthetic oligonucleotide
  Description of Combined DNA/RNA Molecule: Synthetic oligonucleotide
uacaaaagcaaaacagguctt

SEQ ID NO: 1685 - DNA, 21 bp, Artificial Sequence
  Description of Artificial Sequence: Synthetic oligonucleotide
  Description of Combined DNA/RNA Molecule: Synthetic oligonucleotide
accuguuuugcuuuuguaatt

SEQ ID NO: 1686 - DNA, 21 bp, Artificial Sequence
  Description of Artificial Sequence: Synthetic oligonucleotide
  Description of Combined DNA/RNA Molecule: Synthetic oligonucleotide
uuacaaaagcaaaacaggutt

SEQ ID NO: 1687 - DNA, 21 bp, Artificial Sequence
  Description of Artificial Sequence: Synthetic oligonucleotide
  Description of Combined DNA/RNA Molecule: Synthetic oligonucleotide
ccuguuuugcuuuuguaactt

SEQ ID NO: 1688 - DNA, 21 bp, Artificial Sequence
  Description of Artificial Sequence: Synthetic oligonucleotide
  Description of Combined DNA/RNA Molecule: Synthetic oligonucleotide
guuacaaaagcaaaacaggtt

SEQ ID NO: 1689 - DNA, 21 bp, Artificial Sequence
  Description of Artificial Sequence: Synthetic oligonucleotide
  Description of Combined DNA/RNA Molecule: Synthetic oligonucleotide
cuguuuugcuuuuguaacutt

SEQ ID NO: 1690 - DNA, 21 bp, Artificial Sequence
  Description of Artificial Sequence: Synthetic oligonucleotide
  Description of Combined DNA/RNA Molecule: Synthetic oligonucleotide
aguuacaaaagcaaaacagtt

SEQ ID NO: 1691 - DNA, 21 bp, Artificial Sequence
  Description of Artificial Sequence: Synthetic oligonucleotide
  Description of Combined DNA/RNA Molecule: Synthetic oligonucleotide
uguuuugcuuuuguaacuutt

SEQ ID NO: 1692 - DNA, 21 bp, Artificial Sequence
  Description of Artificial Sequence: Synthetic oligonucleotide
  Description of Combined DNA/RNA Molecule: Synthetic oligonucleotide
aaguuacaaaagcaaaacatt

SEQ ID NO: 1693 - DNA, 21 bp, Artificial Sequence
  Description of Artificial Sequence: Synthetic oligonucleotide
  Description of Combined DNA/RNA Molecule: Synthetic oligonucleotide
guuuugcuuuuguaacuugtt

SEQ ID NO: 1694 - DNA, 21 bp, Artificial Sequence
  Description of Artificial Sequence: Synthetic oligonucleotide
  Description of Combined DNA/RNA Molecule: Synthetic oligonucleotide
caaguuacaaaagcaaaactt

SEQ ID NO: 1695 - DNA, 21 bp, Artificial Sequence
  Description of Artificial Sequence: Synthetic oligonucleotide
  Description of Combined DNA/RNA Molecule: Synthetic oligonucleotide
uuuugcuuuuguaacuugatt

SEQ ID NO: 1696 - DNA, 21 bp, Artificial Sequence
  Description of Artificial Sequence: Synthetic oligonucleotide
  Description of Combined DNA/RNA Molecule: Synthetic oligonucleotide
ucaaguuacaaaagcaaaatt

SEQ ID NO: 1697 - DNA, 21 bp, Artificial Sequence
  Description of Artificial Sequence: Synthetic oligonucleotide
  Description of Combined DNA/RNA Molecule: Synthetic oligonucleotide
uuugcuuuuguaacuugaatt

SEQ ID NO: 1698 - DNA, 21 bp, Artificial Sequence
  Description of Artificial Sequence: Synthetic oligonucleotide
  Description of Combined DNA/RNA Molecule: Synthetic oligonucleotide
uucaaguuacaaaagcaaatt

SEQ ID NO: 1699 - DNA, 21 bp, Artificial Sequence
  Description of Artificial Sequence: Synthetic oligonucleotide
  Description of Combined DNA/RNA Molecule: Synthetic oligonucleotide
uugcuuuuguaacuugaagtt

SEQ ID NO: 1700 - DNA, 21 bp, Artificial Sequence
  Description of Artificial Sequence: Synthetic oligonucleotide
  Description of Combined DNA/RNA Molecule: Synthetic oligonucleotide
cuucaaguuacaaaagcaatt

SEQ ID NO: 1701 - DNA, 21 bp, Artificial Sequence
  Description of Artificial Sequence: Synthetic oligonucleotide
  Description of Combined DNA/RNA Molecule: Synthetic oligonucleotide
ugcuuuuguaacuugaagatt

SEQ ID NO: 1702 - DNA, 21 bp, Artificial Sequence
  Description of Artificial Sequence: Synthetic oligonucleotide
  Description of Combined DNA/RNA Molecule: Synthetic oligonucleotide
ucuucaaguuacaaaagcatt

SEQ ID NO: 1703 - DNA, 21 bp, Artificial Sequence
  Description of Artificial Sequence: Synthetic oligonucleotide
  Description of Combined DNA/RNA Molecule: Synthetic oligonucleotide
gcuuuuguaacuugaagautt

SEQ ID NO: 1704 - DNA, 21 bp, Artificial Sequence
  Description of Artificial Sequence: Synthetic oligonucleotide
  Description of Combined DNA/RNA Molecule: Synthetic oligonucleotide
aucuucaaguuacaaaagctt

SEQ ID NO: 1705 - DNA, 21 bp, Artificial Sequence
  Description of Artificial Sequence: Synthetic oligonucleotide
  Description of Combined DNA/RNA Molecule: Synthetic oligonucleotide
cuuuuguaacuugaagauatt

SEQ ID NO: 1706 - DNA, 21 bp, Artificial Sequence
  Description of Artificial Sequence: Synthetic oligonucleotide
  Description of Combined DNA/RNA Molecule: Synthetic oligonucleotide
uaucuucaaguuacaaaagtt

SEQ ID NO: 1707 - DNA, 21 bp, Artificial Sequence
  Description of Artificial Sequence: Synthetic oligonucleotide
  Description of Combined DNA/RNA Molecule: Synthetic oligonucleotide
uuuuguaacuugaagauautt

SEQ ID NO: 1708 - DNA, 21 bp, Artificial Sequence
  Description of Artificial Sequence: Synthetic oligonucleotide
  Description of Combined DNA/RNA Molecule: Synthetic oligonucleotide
auaucuucaaguuacaaaatt

SEQ ID NO: 1709 - DNA, 21 bp, Artificial Sequence
  Description of Artificial Sequence: Synthetic oligonucleotide
  Description of Combined DNA/RNA Molecule: Synthetic oligonucleotide
uuuguaacuugaagauauutt

SEQ ID NO: 1710 - DNA, 21 bp, Artificial Sequence
  Description of Artificial Sequence: Synthetic oligonucleotide
  Description of Combined DNA/RNA Molecule: Synthetic oligonucleotide
aauaucuucaaguuacaaatt

SEQ ID NO: 1711 - DNA, 21 bp, Artificial Sequence
  Description of Artificial Sequence: Synthetic oligonucleotide
  Description of Combined DNA/RNA Molecule: Synthetic oligonucleotide
uuguaacuugaagauauuutt

SEQ ID NO: 1712 - DNA, 21 bp, Artificial Sequence
  Description of Artificial Sequence: Synthetic oligonucleotide
  Description of Combined DNA/RNA Molecule: Synthetic oligonucleotide
aaauaucuucaaguuacaatt

SEQ ID NO: 1713 - DNA, 21 bp, Artificial Sequence
  Description of Artificial Sequence: Synthetic oligonucleotide
  Description of Combined DNA/RNA Molecule: Synthetic oligonucleotide
uguaacuugaagauauuuatt

SEQ ID NO: 1714 - DNA, 21 bp, Artificial Sequence
  Description of Artificial Sequence: Synthetic oligonucleotide
  Description of Combined DNA/RNA Molecule: Synthetic oligonucleotide
uaaauaucuucaaguuacatt

SEQ ID NO: 1715 - DNA, 21 bp, Artificial Sequence
  Description of Artificial Sequence: Synthetic oligonucleotide
  Description of Combined DNA/RNA Molecule: Synthetic oligonucleotide
guaacuugaagauauuuautt

SEQ ID NO: 1716 - DNA, 21 bp, Artificial Sequence
  Description of Artificial Sequence: Synthetic oligonucleotide
  Description of Combined DNA/RNA Molecule: Synthetic oligonucleotide
auaaauaucuucaaguuactt

SEQ ID NO: 1717 - DNA, 21 bp, Artificial Sequence
  Description of Artificial Sequence: Synthetic oligonucleotide
  Description of Combined DNA/RNA Molecule: Synthetic oligonucleotide
uaacuugaagauauuuauutt

SEQ ID NO: 1718 - DNA, 21 bp, Artificial Sequence
  Description of Artificial Sequence: Synthetic oligonucleotide
  Description of Combined DNA/RNA Molecule: Synthetic oligonucleotide
aauaaauaucuucaaguuatt

SEQ ID NO: 1719 - DNA, 21 bp, Artificial Sequence
  Description of Artificial Sequence: Synthetic oligonucleotide
  Description of Combined DNA/RNA Molecule: Synthetic oligonucleotide
aacuugaagauauuuauuctt

SEQ ID NO: 1720 - DNA, 21 bp, Artificial Sequence
  Description of Artificial Sequence: Synthetic oligonucleotide
  Description of Combined DNA/RNA Molecule: Synthetic oligonucleotide
gaauaaauaucuucaaguutt

SEQ ID NO: 1721 - DNA, 21 bp, Artificial Sequence
  Description of Artificial Sequence: Synthetic oligonucleotide
  Description of Combined DNA/RNA Molecule: Synthetic oligonucleotide
acuugaagauauuuauucutt

SEQ ID NO: 1722 - DNA, 21 bp, Artificial Sequence
  Description of Artificial Sequence: Synthetic oligonucleotide
  Description of Combined DNA/RNA Molecule: Synthetic oligonucleotide
agaauaaauaucuucaagutt

SEQ ID NO: 1723 - DNA, 21 bp, Artificial Sequence
  Description of Artificial Sequence: Synthetic oligonucleotide
  Description of Combined DNA/RNA Molecule: Synthetic oligonucleotide
cuugaagauauuuauucugtt

SEQ ID NO: 1724 - DNA, 21 bp, Artificial Sequence
  Description of Artificial Sequence: Synthetic oligonucleotide
  Description of Combined DNA/RNA Molecule: Synthetic oligonucleotide
cagaauaaauaucuucaagtt

SEQ ID NO: 1725 - DNA, 21 bp, Artificial Sequence
  Description of Artificial Sequence: Synthetic oligonucleotide
  Description of Combined DNA/RNA Molecule: Synthetic oligonucleotide
uugaagauauuuauucuggtt

SEQ ID NO: 1726 - DNA, 21 bp, Artificial Sequence
  Description of Artificial Sequence: Synthetic oligonucleotide
  Description of Combined DNA/RNA Molecule: Synthetic oligonucleotide
ccagaauaaauaucuucaatt

SEQ ID NO: 1727 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1728 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1729 - DNA, 21 bp, Artificial Sequence
  Description of Artificial Sequence: Synthetic oligonucleotide
  Description of Combined DNA/RNA Molecule: Synthetic oligonucleotide
gaagauauuuauucugggutt

SEQ ID NO: 1730 - DNA, 21 bp, Artificial Sequence
  Description of Artificial Sequence: Synthetic oligonucleotide
  Description of Combined DNA/RNA Molecule: Synthetic oligonucleotide
acccagaauaaauaucuuctt

SEQ ID NO: 1731 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1732 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

The invention claimed is:

1. A composition comprising a nucleic acid lipid particle comprising a double-stranded ribonucleic acid (dsRNA) for inhibiting the expression of a human PCSK9 gene in a cell, wherein:
   the nucleic acid lipid particle comprises a lipid formulation comprising 45-65 mol % of a cationic lipid, 5 mol % to about 10 mol %, of a non-cationic lipid, 25-40 mol % of a sterol, and 0.5-5 mol % of a PEG or PEG-modified lipid and the cationic lipid comprises MC3 (((6Z,9Z,28Z,31Z)-heptatriaconta-6,9,28,31-tetraen-19-yl 4-(dimethylamino)butanoate),
   the dsRNA consists of a sense strand and an antisense strand,
   wherein the sense strand consists of the nucleotide sequence of SEQ ID NO:1227 and the antisense strand consists of the nucleotide sequence of SEQ ID NO:1228.

2. The composition of claim 1, wherein each strand is modified as follows to include a 2'-O-methyl ribonucleotide as indicated by a lower case letter "c" or "u" and a phosphorothioate as indicated by a lower case letter "s":
   the dsRNA consists of a sense strand consisting of
   SEQ ID NO:1229 (5'-uucuAGAccuGuuuuGcuuTsT-3')
   and an antisense strand consisting of
   SEQ ID NO:1230 (5'-AAGcAAAAcAGGUCuAGAATsT-3').

3. The composition of claim 1 or 2, wherein the lipid formulation is selected from the group consisting of:

| | |
|---|---|
| LNP11 | MC3/DSPC/Cholesterol/PEG-DMG 50/10/38.5/1.5 |
| LNP14 | MC3/DSPC/Cholesterol/PEG-DMG 40/15/40/5 |
| LNP15 | MC3/DSPC/Cholesterol/PEG-DSG/GalNAc-PEG-DSG 50/10/35/4.5/0.5 |

-continued

| | |
|---|---|
| LNP16 | MC3/DSPC/Cholesterol/PEG-DMG 50/10/38.5/1.5 |
| LNP17 | MC3/DSPC/Cholesterol/PEG-DSG 50/10/38.5/1.5 |
| LNP18 | MC3/DSPC/Cholesterol/PEG-DMG 50/10/38.5/1.5 |
| LNP19 | MC3/DSPC/Cholesterol/PEG-DMG 50/10/35/5 |
| LNP20 | MC3/DSPC/Cholesterol/PEG-DPG 50/10/38.5/1.5. |

4. The composition of claim 1 or claim 2, further comprising a lipoprotein.

5. The composition of claim 1 or claim 2, further comprising apolipoprotein E (ApoE).

6. The composition of claim 5, wherein the dsRNA is conjugated to a lipophile.

7. The composition of claim 6, wherein the lipophile is cholesterol.

8. The composition of claim 5, wherein the ApoE is reconstituted with at least one amphiphilic agent.

9. The composition of claim 8, wherein the amphiphilic agent is a phospholipid.

10. The composition of claim 8, wherein the amphilic agent is a phospholipid selected from the group consisting of dimyristoyl phosphatidyl choline (DMPC), dioleoylphosphatidylethanolamine (DOPE), palmitoyloleoylphosphatidylcholine (POPC), egg phosphatidylcholine (EPC), distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), -phosphatidylethanolamine (POPE), dioleoyl-phosphatidylethanolamine 4-(N-maleimidomethyl)-cyclohexane-1-carboxylate (DOPE-mal), and combinations thereof.

11. The composition of claim 9, wherein the ApoE is reconstituted high density lipoprotein (rHDL).

12. The composition of claim 3, further comprising a lipoprotein.

13. The composition of claim 3, further comprising apolipoprotein E (ApoE).

14. The composition of claim 13, wherein the dsRNA is conjugated to a lipophile.

15. The composition of claim 14, wherein the lipophile is cholesterol.

16. The composition of claim 15, wherein the ApoE is reconstituted with at least one amphiphilic agent.

17. The composition of claim 16, wherein the amphiphilic agent is a phospholipid.

18. The composition of claim 16, wherein the amphilic agent is a phospholipid selected from the group consisting of dimyristoyl phosphatidyl choline (DMPC), dioleoylphosphatidylethanolamine (DOPE), palmitoyloleoylphosphatidylcholine (POPC), egg phosphatidylcholine (EPC), distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), -phosphatidylethanolamine (POPE), dioleoyl-phosphatidylethanolamine 4-(N-maleimidomethyl)-cyclohexane-1-carboxylate (DOPE-mal), and combinations thereof.

19. The composition of claim 13, wherein the ApoE is reconstituted high density lipoprotein (rHDL).

20. The composition of claim 3, wherein the lipid formulation is LNP11.

21. The composition of claim 3, wherein the lipid formulation is LNP14.

22. The composition of claim 3, wherein the lipid formulation is LNP15.

23. The composition of claim 3, wherein the lipid formulation is LNP16.

24. The composition of claim 3, wherein the lipid formulation is LNP17.

25. The composition of claim 3, wherein the lipid formulation is LNP18.

26. The composition of claim 3, wherein the lipid formulation is LNP19.

27. The composition of claim 3, wherein the lipid formulation is LNP20.

* * * * *